(12) United States Patent
Mallet et al.

(10) Patent No.: US 11,453,916 B2
(45) Date of Patent: Sep. 27, 2022

(54) METHOD FOR IN VITRO DIAGNOSIS OR PROGNOSIS OF COLON CANCER

(71) Applicants: BIOMERIEUX, Marcy l'Etoile (FR); HOSPICES CIVILS DE LYON, Lyons (FR)

(72) Inventors: François Mallet, Villeurbanne (FR); Nathalie Mugnier, Lyons (FR); Philippe Perot, Lyons (FR)

(73) Assignees: BIOMERIEUX, Marcy l'Etoile (FR); HOSPICES CIVILS DE LYON, Lyons (FR)

( * ) Notice: Subject to any disclaimer, the term of this patent is extended or adjusted under 35 U.S.C. 154(b) by 220 days.

(21) Appl. No.: 14/367,526

(22) PCT Filed: Dec. 17, 2012

(86) PCT No.: PCT/FR2012/052954
§ 371 (c)(1),
(2) Date: Jun. 20, 2014

(87) PCT Pub. No.: WO2013/093315
PCT Pub. Date: Jun. 27, 2013

(65) Prior Publication Data
US 2014/0349857 A1 Nov. 27, 2014

(30) Foreign Application Priority Data
Dec. 20, 2011 (FR) ..................... 11/62049

(51) Int. Cl.
*C12Q 1/6886* (2018.01)
*G01N 33/574* (2006.01)
*C12Q 1/70* (2006.01)

(52) U.S. Cl.
CPC ..... *C12Q 1/6886* (2013.01); *G01N 33/57419* (2013.01); *C12Q 1/702* (2013.01); *C12Q 2600/158* (2013.01); *C12Q 2600/16* (2013.01); *G01N 2800/52* (2013.01)

(58) Field of Classification Search
CPC combination set(s) only.
See application file for complete search history.

(56) References Cited

U.S. PATENT DOCUMENTS

2001/0053519 A1* 12/2001 Fodor ................. B01J 19/0046
435/6.11
2015/0065369 A1* 3/2015 Perot ................... C12Q 1/6886
506/9

FOREIGN PATENT DOCUMENTS

| EP | 1338606 A1 * | 8/2003 | ........... C07K 14/005 |
|---|---|---|---|
| EP | 1338606 A1 | 8/2003 | |
| EP | 2 340 851 A1 | 7/2011 | |
| WO | WO-9511995 A1 * | 5/1995 | ............. B82Y 30/00 |
| WO | WO 9823755 A1 * | 6/1998 | ........... C07K 14/005 |
| WO | WO 0246477 A2 * | 6/2002 | ........... C07K 14/005 |
| WO | 2011153684 A1 | 12/2011 | |
| WO | WO 2013093347 A2 * | 6/2013 | ........... C12Q 1/6886 |
| WO | WO 2013093356 A2 * | 6/2013 | ........... C12Q 1/6886 |

OTHER PUBLICATIONS

Perot et al (PLOS One (2012) vol. 7, pp. e40194).*
Benner et al (Trends in Genetics (2001) vol. 17, pp. 414-418).*
Cheung et al (Nature Genetics, 2003, vol. 33, pp. 422-425).*
Saito-Hisaminato et al. (DNA research (2002) vol. 9, pp. 35-45).*
Wu (Journal of Pathology, 2001, vol. 195, pp. 53-65).*
Greenbaum et al (Genome Biology 2003, vol. 4, article 117, pp. 1-8).*
Munroe et al (Molecular and Cellular Biology (1990) vol. 10, pp. 3441-3455).*
Ncbi blast ( http://blast.ncbi.nlm.nih.gov/Blast.cgi, May 25, 2016.*
Subramanian et al (Retrovirology (2011) vol. 8, 90 (pp. 1-23)(e published Nov. 10, 2011).*
GenBank accession No. AL121761.5 GI:7161782 (http://www.ncbi.nlm.nih.gov/nuccore/7161782?sat=8&satkey=657763, Mar. 3, 2000).*
GenBank Accession AC079264.23 GI:14670062 (http://www.ncbi.nlm.nih.gov/nuccore/14670062, Apr. 2, 2002).*
Caron ( Science (2001) vol. 291, pp. 1289-2992 and supplemental content).*
Lower ( Proceedings National Academy of Science (1996) vol. 93, pp. 5177-5184).*
Liang et al (Biochemical and Biophysical Research Communications (2009) vol. 382, pp. 468-472).*
Blast RID HZJNACT001R (https://blast.ncbi.nlm.nih.gov/Blast.cgi, downloaded Jun. 12, 2018).*
Wada (Genes & Development (1998) vol. 12, pp. 343-356).*
Kovalskaya (virology (2006) vol. 346, pp. 373-378).*
GenBank Accession AC006146.2 (https://www.ncbi.nlm.nih.gov/nucleotide/AC006146.2?report=genbank&log$=nuclalign&blast_rank=2&RID=VGAPZV02015, Dec. 10, 2008).*
Udvardi (The Plant Cell (2008) vol. 20, pp. 1736-1737).*
Burt (gastroenterology (2000) vol. 199, pp. 837-853).*
Pace (nucleic Acid research (2004) vol. 32, D50).*
Jul. 1, 2013 International Search Report issued in International Application No. PCT/FR2012/052954.
Jul. 1, 2013 Written Opinion issued in International Application No. PCT/FR2012/052954.

(Continued)

*Primary Examiner* — Steven Pohnert
(74) *Attorney, Agent, or Firm* — Oliff PLC (57) ABSTRACT

The present invention relates to a method for in vitro diagnosis or prognosis of colon cancer, including a step of detecting at least one expression product of at least one HERV nucleic acid sequence, the use of said isolated nucleic acid sequences as a molecular marker/molecular markers, and a kit including at least one specific binding partner for at least one expression product of the HERV nucleic acid sequences.

16 Claims, 3 Drawing Sheets

Specification includes a Sequence Listing.

(56) References Cited

OTHER PUBLICATIONS

Wentzensen, Nicolas et al. "Identification of Differentially Expressed Genes In Colorectal Adenoma Compared to Normal Tissue by Suppresion Subtractive Hybridization," International Journal of Oncology, 2004, vol. 24, pp. 987-994.

Alves, Pedro M. S. et al, "Identification of Tumor-Associated Antigens by Large-Scale Analysis of Genes Expressed In Human Colorectal Cancer," Cancer Immunity, Jun. 27, 2008, vol. 8, pp. 1-11.

Gimenez, Juliette et al., "Custom Human Endogenous Retroviruses Dedicated Microarray Identifies Self-Induced HERV-W Family Elements Reactivated in Testicular Cancer Upon Methylation Control," Nucleic Acids Research, 2010, vol. 38, No. 7, pp. 2229-2246.

Ahn, Kung et al., "Structural and Quantitative Expression Analyses of HERV Gene Family in Human Tissues," Molecules and Cells, Aug. 31, 2009, vol. 28, No. 2, pp. 99-103.

Liang, Qiaoyi et al., "Identification of a Novel Human Endogenous Retrovirus and Promoter Activity of its 5' U3," Biochemical and Biophysical Research Communications, 2009, vol. 382, No. 2, pp. 468-472.

Liang, Qiaoyi et al., "Identification and Detection of a Novel Human Endogenous Retrovirus-related Gene, and Structural Characterization of its Related Elements," Genetics and Molecular Biology, 2009, vol. 32, No. 4, pp. 704-708.

"*Homo sapiens* Chromosome 5 Clone RP11-520E18, Complete Sequence," XP-002694332, pp. 1-42.

Paces, Jan et al., "HERVd: the Human Endogenous RetroViruses Database: Update," Nucleic Acids Research, 2004, vol. 32, pp. 1.

"*Homo sapiens* Endogenous Virus HERV-H mRNA," XP-002681591, pp. 1-2.

"*Homo sapiens* Xp BAC RP11-315B16 (Roswell Park Center Institute Human BAC Library) Complete Sequence," XP-002698154, pp. 1-62.

"Human DNA Sequence From Clone RP1-122P22 on Chromosome 20," XP-002698155, pp. 1-30.

"*Homo sapiens* BAC clone RP11-563E2 from 4, Complete Sequence," XP-002698156, pp. 1-60.

Homo Spaiens PAC Clone RP4-693M11 from 14q24.3, Complete Sequence, XP-002698157, pp. 1-42.

Nickerson, Deborah A. et al., "DNA Sequence Diversity in a 9.7-kb Region of the Human Lipoprotein Lipase Gene," Nature Genetics, vol. 19, Jul. 1998, vol. 19, pp. 233-240.

Navarro, Gonzalo et al., "Flexible Pattern Matching in Strings," Cambridge University Press, 2002.

Irizarry, Rafael A., "Exploration, Normalization, and Summaries of High Density Oligonucleotide Array Probe Level Data," Biostatistics, 2003, vol. 4, No. 2, pp. 249-264.

Johnson, W. Evan et. al, "Adjusting Batch Effects in Microarray Expression Data Using Empirical Bayes Methods," Biostatistics, 2007, vol. 8, No. 1, pp. 118-127.

Storey, John D. et al., "Statistical Signficance for Genomewide Studies," PNAS, Aug. 5, 2003, vol. 100, No. 16, pp. 9440-9445.

Tusher, Virginia Goss et al., "Significance Analysis of Microarrays Applied to the Ionizing Radiation Response," PNAS, Apr. 24, 2001, vol. 98, No. 9, pp. 5116-5121.

* cited by examiner

METHOD FOR IN VITRO DIAGNOSIS OR PROGNOSIS OF COLON CANCER

Endogenous retroviruses constitute the progeny of infectious retroviruses which have integrated, in their proviral form, into germ line cells and which have been transmitted via this means into the genome of the progeny of the host.

The sequencing of the human genome has made it possible to reveal the extremely high abundance of transposable elements or derivatives thereof. In fact, repeated sequences represent close to half the human genome and endogenous retroviruses and retrotransposons make up 8% of said genome, with the number of elements, at the current time, coming to more than 400,000.

The abundance of endogenous retroviral elements (ERVs) currently present in the human genome is the result of about 100 endogenizations which have successfully taken place during the course of the evolution of the human line. The various waves of endogenization are spread out over a period ranging from 2 to 90 million years before our era and have been followed by the expansion of the number of copies via phenomena of the "copy/paste" type with the possibility of the appearance of errors, resulting, starting from an ancestral provirus, in the formation of a family of HERVs, i.e. a set of elements which exhibit sequence homologies. The oldest elements, those of the HERV-L family, supposedly became integrated before the emergence of mammals. Two families, HERV-F and HERV-H, appeared during the period when the first primates were making their appearance. The HERV-FRD and HERV-K(HML-5) families, integrated 40 to 55 million years ago, are specific for higher primates. On the other hand, the HERV-W and HERV-E families, for example, became integrated 5 to 10 million years later, after the separation with New World monkeys, and are specific for the Catarrhini (Hominoids and Cercopithecidae).

The ERV sequences are represented on all the chromosomes, with a varying density according to the families, and there is no correlation between the physical proximity of ERVs and their phylogenetic proximity.

For a long time, ERVs have been considered to be parasites or to be simple DNA waste. Nevertheless, the impact of ERVs on the organism is not only limited to their past participation in modelling the genome or to deleterious recombinations which may still provide support.

The abundance and the structural complexity of ERVs makes analyses of their expression very complicated and often difficult to interpret. The detection of HERV expression may reflect the transcriptional activation of one or more loci within the same family. The activated locus or loci may in addition vary according to the tissue and/or the context.

The present inventors have now discovered and demonstrated that nucleic acid sequences corresponding to precisely identified loci of endogenous retroviral elements are associated with colon cancer and that these sequences are molecular markers of the pathological condition. The sequences identified are either proviruses, i.e. sequences containing all or part of the gag, pol and any genes flanked in the 5' and 3' positions by long terminal repeats (LTRs), or all or part of the LTRs or of the genes isolated. The DNA sequences identified are respectively referenced as SEQ ID NOs: 1 to 285 in the sequence listing, their chromosomal location is identified in the table below (NCBI 36/hg18), as are their expression, overexpression or underexpression represented by the "expression ratio" between cancer sample and normal sample. When the expression of the nucleic acid or the change in the expression of the nucleic acid is specific for colon tissue, this information is indicated by the symbol "x" in the target tissue column. This signifies that, if an expression or a change in expression of the nucleic acid concerned is determined in a biological compartment other than colon tissue, this represents, remotely, a signature of colon cancer. The DNA sequences identified as being specific for colon tissue are respectively referenced as SEQ ID NOs: 1, 2, 3, 4, 5, 7, 8, 9, 10, 11, 12, 13, 17, 19, 22, 24, 25, 27 and 97 in the sequence listing. The DNA sequences identified as being not specific for colon tissue are respectively referenced as SEQ ID NOs: 6, 14, 15, 16, 18, 20, 21, 23, 26, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284 and 285.

TABLE

| SEQ ID NO: | Chromosomal location | Target tissue | Cancer/normal expression ratio |
|---|---|---|---|
| 1 | (−) chr 5: 135904531-135912105 | x | 43.8 |
| 2 | (−) chr 1: 4468515-4474361 | x | 34.7 |
| 3 | (−) chr 20: 19680691-19685420 | x | 19.4 |
| 4 | (+) chr 4: 183972457-183977066 | x | 12.5 |
| 5 | (+) chr 13: 108715439-108721465 | x | 10.9 |
| 6 | (−) chr 1: 204451670-204454441 |  | −8.6 |
| 7 | (−) chr 7: 26030345-26035880 | x | 8.4 |
| 8 | (+) chr 14: 73239795-73245370 | x | 8.3 |
| 9 | (−) chr 5: 179775292-179781337 | x | 7.7 |
| 10 | (−) chr 14: 30785319-30790095 | x | 7.6 |
| 11 | (−) chr 3: 45773285-45774220 | x | 6.7 |
| 12 | (+) chr 16: 84869202-84872386 | x | 6.4 |
| 13 | (−) chr 11: 130128601-130134242 | x | 5.9 |
| 14 | (−) chr 10: 6711545-6717509 |  | 5.7 |
| 15 | (+) chr 8: 86591572-86592049 |  | −5.6 |
| 16 | (+) chr 12: 25207414-25213718 |  | 5.6 |
| 17 | (+) chr 8: 98256433-98262143 | x | 4.9 |
| 18 | (+) chr 1: 201726731-201727141 |  | −4.8 |
| 19 | (−) chr 8: 80460894-80463081 | x | 4.8 |
| 20 | (+) chr 8: 105367316-105373215 |  | 4.8 |
| 21 | (+) chr 17: 11815798-11820989 |  | 4.7 |
| 22 | (−) chr 18: 24526989-24532843 | x | 4.5 |
| 23 | (+) chr 22: 15472270-15476039 |  | 4.2 |
| 24 | (−) chr 8: 91171628-91177272 | x | 4.2 |
| 25 | (+) chr 1: 176275999-176281686 | x | 4.2 |
| 26 | (−) chr 19: 48519503-48525376 |  | 4.1 |
| 27 | (+) chr 9: 25658927-25666384 | x | 3.7 |
| 28 | (+) chr 13: 34271392-34275485 |  | 3.7 |
| 29 | (−) chr 11: 60237235-60238528 |  | −3.6 |
| 30 | (+) chr 8: 116896352-116900252 |  | 3.2 |
| 31 | (+) chr 19: 60146916-60147844 |  | 3.2 |
| 32 | (+) chr 2: 188084458-188084785 |  | −3.1 |
| 33 | (+) chr 10: 98482752-98486365 |  | 2.9 |
| 34 | (−) chr 8: 99671725-99672015 |  | 2.9 |

TABLE-continued

| SEQ ID NO: | Chromosomal location | Target tissue | Cancer/normal expression ratio |
|---|---|---|---|
| 35 | (−) chr 13: 55586741-55590394 | | 2.8 |
| 36 | (−) chr X: 93840473-93846744 | | −2.8 |
| 37 | (−) chr 4: 93411664-93417822 | | 2.5 |
| 38 | (+) chr 4: 121134267-121140271 | | 2.5 |
| 39 | (−) chr 5: 135912105-135915610 | | 2.5 |
| 40 | (−) chr 6: 82110364-82117596 | | −2.4 |
| 41 | (−) chr 6: 123945178-123950851 | | 2.4 |
| 42 | (−) chr 2: 71238414-71246247 | | 2.4 |
| 43 | (−) chr 1: 171684177-171684627 | | −2.3 |
| 44 | (−) chr 10: 65936583-65936972 | | 2.3 |
| 45 | (+) chr 14: 50429630-50433350 | | 2.3 |
| 46 | (+) chr 14: 41054824-41060836 | | 2.3 |
| 47 | (−) chr 5: 34514678-34514916 | | 2.2 |
| 48 | (−) chr 8: 115366935-115369140 | | 2.2 |
| 49 | (−) chr 11: 73926652-73927082 | | 2.2 |
| 50 | (−) chr 14: 22736836-22737207 | | 2.2 |
| 51 | (−) chr 1: 79726879-79732396 | | 2.2 |
| 52 | (+) chr 3: 130161351-130164778 | | 2.1 |
| 53 | (−) chr 12: 11656097-11659027 | | −2.1 |
| 54 | (−) chr 17: 72113663-72119188 | | 2.1 |
| 55 | (−) chr 11: 123241237-123246982 | | 2.1 |
| 56 | (−) chr 8: 136848614-136854437 | | 2.1 |
| 57 | (+) chr 3: 135222763-135223084 | | −2.1 |
| 58 | (+) chr 12: 94666771-94672799 | | 2.1 |
| 59 | (+) chr 6: 63559535-63565316 | | −2.1 |
| 60 | (−) chr 2: 54587807-54590183 | | −2.0 |
| 61 | (+) chr 2: 173115073-173117251 | | 2.0 |
| 62 | (+) chr 5: 755586-759445 | | 2.0 |
| 63 | (+) chr 8: 129995887-130001750 | | 2.0 |
| 64 | (+) chr 4: 127503905-127504662 | | 2.0 |
| 65 | (−) chr 21: 41718929-41719369 | | 2.0 |
| 66 | (+) chr 20: 40489715-40490155 | | 2.0 |
| 67 | (+) chr 7: 100274888-100276065 | | 2.0 |
| 68 | (+) chr 7: 35702274-35703153 | | 2.0 |
| 69 | (+) chr 6: 131686129-131689771 | | −2.0 |
| 70 | (−) chr 1: 226879232-226884835 | | 2.0 |
| 71 | (−) chr 10: 17712042-17714165 | | 1.9 |
| 72 | (−) chr 10: 53463521-53469327 | | 1.9 |
| 73 | (−) chr X: 112238600-112244308 | | 1.9 |
| 74 | (−) chr 1: 146722974-146723946 | | 1.9 |
| 75 | (+) chr 1: 53671142-53673436 | | 1.9 |
| 76 | (−) chr X: 91414738-91420449 | | −1.9 |
| 77 | (−) chr 7: 16683220-16684043 | | 1.9 |
| 78 | (+) chr 10: 100097920-100098685 | | 1.9 |
| 79 | (+) chr 22: 31228741-31234490 | | 1.8 |
| 80 | (−) chr 13: 112501931-112502014 | | 1.8 |
| 81 | (+) chr 1: 146832410-146833382 | | 1.8 |
| 82 | (−) chr 10: 20449793-20453869 | | 1.8 |
| 83 | (+) chr 9: 21911892-21921934 | | 1.8 |
| 84 | (−) chr 3: 186574589-186580188 | | −1.8 |
| 85 | (−) chr 10: 62463482-62469677 | | −1.8 |
| 86 | (−) chr 15: 97959745-97960384 | | −1.7 |
| 87 | (+) chr 17: 75988189-75996283 | | −1.7 |
| 88 | (+) chr 2: 88760597-88762729 | | 1.7 |
| 89 | (+) chr 7: 29791133-29794522 | | 1.7 |
| 90 | (+) chr 18: 50528195-50528890 | | −1.7 |
| 91 | (+) chr 1: 89162808-89170138 | | −1.7 |
| 92 | (−) chr 3: 178866314-178871614 | | −1.7 |
| 93 | (−) chr 19: 52245264-52250506 | | 1.7 |
| 94 | (+) chr 17: 30852752-30853047 | | −1.7 |
| 95 | (−) chr 11: 69581214-69582655 | | 1.7 |
| 96 | (+) chr 5: 138886787-138888726 | | −1.7 |
| 97 | (−) chr 3: 167701085-167706900 | x | 1.7 |
| 98 | (+) chr 1: 101404629-101404696 | | 1.7 |
| 99 | (+) chr 8: 113277279-113282810 | | −1.6 |
| 100 | (−) chr 20: 740491-741481 | | 1.6 |
| 101 | (−) chr 2: 58194071-58199769 | | 1.6 |
| 102 | (+) chr 13: 35788462-35794330 | | −1.6 |
| 103 | (+) chr 9: 12938344-12944129 | | 1.6 |
| 104 | (−) chr 9: 116976750-116982362 | | −1.6 |
| 105 | (+) chr 4: 11264289-11269976 | | −1.6 |
| 106 | (−) chr 1: 223094264-223100407 | | −1.6 |
| 107 | (+) chr 7: 92862465-92866875 | | 1.6 |
| 108 | (−) chr 17: 72296838-72297401 | | −1.6 |
| 109 | (+) chr X: 86823336-86830473 | | 1.6 |
| 110 | (−) chr X: 89718079-89718557 | | −1.6 |
| 111 | (−) chr 3: 58397972-58398349 | | −1.6 |
| 112 | (−) chr 2: 215413351-215413804 | | −1.6 |
| 113 | (+) chr 4: 87614948-87620699 | | 1.6 |
| 114 | (−) chr 1: 54874382-54875358 | | −1.6 |
| 115 | (+) chr 1: 237429952-237430254 | | 1.6 |
| 116 | (−) chr 7: 79651365-79652053 | | −1.6 |
| 117 | (−) chr 4: 180711319-180712287 | | −1.5 |
| 118 | (−) chr 5: 146727162-146727562 | | −1.5 |
| 119 | (+) chr 3: 156178559-156179784 | | −1.5 |
| 120 | (+) chr 1: 51465235-51468757 | | −1.5 |
| 121 | (−) chr 3: 100178327-100178459 | | 1.5 |
| 122 | (−) chr 4: 67932305-67932737 | | 1.5 |
| 123 | (−) chr 18: 24532993-24533490 | | 1.5 |
| 124 | (−) chr 12: 20862483-20866818 | | 1.5 |
| 125 | (−) chr 12: 8334466-8337953 | | −1.5 |
| 126 | (−) chr 13: 94759022-94759378 | | −1.5 |
| 127 | (−) chr 1: 144779633-144780605 | | 1.5 |
| 128 | (+) chr 1: 143314771-143315743 | | 1.5 |
| 129 | (+) chr 2: 231645891-231645949 | | 1.5 |
| 130 | (−) chr 7: 65721380-65722348 | | −1.5 |
| 131 | (+) chr 2: 188606470-188612115 | | −1.5 |
| 132 | (−) chr 3: 176879333-176879730 | | −1.5 |
| 133 | (−) chr 3: 186765708-186772209 | | 1.5 |
| 134 | (−) chr 11: 67377518-67381008 | | 1.5 |
| 135 | (−) chr 12: 123157590-123158004 | | 1.5 |
| 136 | (+) chr 7: 134507781-134510522 | | −1.5 |
| 137 | (+) chr 12: 112980007-112980079 | | −1.5 |
| 138 | (−) chr 10: 101571639-101577563 | | 1.5 |
| 139 | (+) chr 8: 81814506-81817982 | | −1.5 |
| 140 | (−) chr 12: 29178820-29185001 | | −1.5 |
| 141 | (−) chr 5: 119558433-119559245 | | −1.5 |
| 142 | (−) chr 13: 23891789-23892035 | | 1.5 |
| 143 | (−) chr 1: 51845967-51846990 | | −1.5 |
| 144 | (−) chr 19: 58630272-58630359 | | 1.5 |
| 145 | (−) chr 3: 193273756-193277341 | | −1.5 |
| 146 | (+) chr 6: 149002601-149008339 | | −1.5 |
| 147 | (+) chr 3: 186986788-186967217 | | 1.5 |
| 148 | (−) chr 3: 192866741-192872861 | | 1.5 |
| 149 | (+) chr 4: 69952306-69955060 | | −1.4 |
| 150 | (−) chr 14: 38837505-38837576 | | 1.4 |
| 151 | (+) chr 2: 57102769-57103266 | | −1.4 |
| 152 | (−) chr 3: 130032422-130036475 | | −1.4 |
| 153 | (+) chr 4: 54112155-54112817 | | −1.4 |
| 154 | (−) chr 3: 146311752-146313676 | | 1.4 |
| 155 | (−) chr 12: 14769094-14769447 | | 1.4 |
| 156 | (+) chr 13: 55512386-55518412 | | 1.4 |
| 157 | (+) chr 15: 72433538-72439180 | | −1.4 |
| 158 | (+) chr 3: 40577391-40583175 | | −1.4 |
| 159 | (−) chr 4: 120675771-120676048 | | −1.4 |
| 160 | (−) chr 8: 12395268-12398823 | | 1.4 |
| 161 | (−) chr X: 101106329-101106710 | | 1.4 |
| 162 | (−) chr 3: 190138663-190139459 | | −1.4 |
| 163 | (−) chr 3: 98473995-98479084 | | −1.4 |
| 164 | (+) chr 10: 5070454-5070498 | | −1.4 |
| 165 | (+) chr 15: 14710170-114711150 | | 1.4 |
| 166 | (+) chr 3: 128381736-128382403 | | −1.4 |
| 167 | (+) chr 9: 22813029-22813838 | | −1.4 |
| 168 | (−) chr 2: 231673651-231673769 | | 1.4 |
| 169 | (+) chr 3: 116946112-116948448 | | 1.4 |
| 170 | (−) chr 11: 92482373-92482685 | | 1.4 |
| 171 | (+) chr 4: 167867005-167868159 | | 1.4 |
| 172 | (+) chr 1: 144779633-144780605 | | 1.4 |
| 173 | (+) chr 20: 58157372-58158054 | | 1.4 |
| 174 | (−) chr 4: 138339335-138340015 | | −1.4 |
| 175 | (−) chr 12: 71688770-71689742 | | 1.4 |
| 176 | (+) chr 13: 63310225-63315979 | | −1.4 |
| 177 | (−) chr 1: 110201971-110202287 | | −1.4 |
| 178 | (+) chr 10: 92557026-92562997 | | −1.4 |
| 179 | (+) chr 1: 38146074-38152175 | | −1.4 |
| 180 | (+) chr 6: 153045773-153046224 | | 1.4 |
| 181 | (−) chr 1: 79934615-79940335 | | −1.4 |
| 182 | (+) chr 4: 155197148-155204405 | | −1.4 |

TABLE-continued

| SEQ ID NO: | Chromosomal location | Target tissue | Cancer/normal expression ratio |
|---|---|---|---|
| 183 | (+) chr 13: 40927858-40928571 | | 1.4 |
| 184 | (+) chr 4: 11974611-11980403 | | −1.3 |
| 185 | (+) chr 18: 4676671-4682409 | | −1.3 |
| 186 | (−) chr 21: 14575132-14576104 | | −1.3 |
| 187 | (+) chr 5: 180186875-180187838 | | −1.3 |
| 188 | (+) chr 4: 68579259-68585888 | | −1.3 |
| 189 | (−) chr 11: 27607193-27613049 | | −1.3 |
| 190 | (+) chr 18: 6123610-6123972 | | −1.3 |
| 191 | (+) chr 14: 57658752-57662615 | | −1.3 |
| 192 | (−) chr 1: 144213068-144214036 | | −1.3 |
| 193 | (−) chr 4: 62312529-62318338 | | −1.3 |
| 194 | (+) chr 1: 45751770-45752724 | | −1.3 |
| 195 | (−) chr 17: 6577008-6581495 | | −1.3 |
| 196 | (−) chr 1: 244819996-244820439 | | −1.3 |
| 197 | (−) chr 9: 100067414-100073409 | | 1.3 |
| 198 | (+) chr 3: 196356095-196356926 | | −1.3 |
| 199 | (+) chr 12: 31851416-31851846 | | −1.3 |
| 200 | (−) chr 5: 118311697-118316179 | | −1.3 |
| 201 | (−) chr 1: 94806343-94810970 | | −1.3 |
| 202 | (+) chr 2: 185332604-185332980 | | −1.3 |
| 203 | (+) chr 4: 107250443-107255274 | | −1.3 |
| 204 | (−) chr 18: 31472178-31472680 | | −1.3 |
| 205 | (+) chr 6: 38501905-38502660 | | −1.3 |
| 206 | (−) chr 15: 49734758-49735530 | | 1.3 |
| 207 | (−) chr X: 84258326-84258441 | | −1.3 |
| 208 | (+) chr 5: 55618832-55619003 | | −1.3 |
| 209 | (−) chr 17: 16678919-16679896 | | 1.3 |
| 210 | (+) chr 2: 193715387-193716358 | | −1.3 |
| 211 | (+) chr 5: 115014416-115019003 | | 1.3 |
| 212 | (+) chr 17: 22039285-22039750 | | −1.3 |
| 213 | (+) chr 5: 108685641-108685853 | | −1.3 |
| 214 | (+) chr 10: 65474521-65475382 | | −1.3 |
| 215 | (−) chr 6: 89180631-89187940 | | 1.3 |
| 216 | (+) chr 1: 244312610-244313561 | | 1.3 |
| 217 | (+) chr 5: 76822592-76823033 | | −1.3 |
| 218 | (−) chr Y: 4283432-4289271 | | −1.3 |
| 219 | (+) chr 5: 71075676-71076376 | | −1.3 |
| 220 | (+) chr 2: 24861412-24861769 | | −1.3 |
| 221 | (−) chr 1: 110196377-110201971 | | −1.3 |
| 222 | (+) chr 3: 177261846-177267467 | | −1.3 |
| 223 | (+) chr 7: 6908153-6909119 | | −1.3 |
| 224 | (−) chr 12: 33132053-33135058 | | −1.3 |
| 225 | (+) chr 7: 146321019-146321687 | | 1.3 |
| 226 | (+) chr 4: 54581003-54585874 | | −1.3 |
| 227 | (+) chr X: 138823266-138823672 | | −1.3 |
| 228 | (+) chr 18: 2829330-2829995 | | −1.3 |
| 229 | (+) chr 6: 66335631-66336029 | | −1.3 |
| 230 | (−) chr 6: 121983265-121989145 | | −1.3 |
| 231 | (−) chr 2: 226039745-226040459 | | −1.3 |
| 232 | (+) chr 4: 109853300-109855458 | | 1.3 |
| 233 | (−) chr 19: 20126744-20133095 | | −1.3 |
| 234 | (−) chr 11: 14839752-14840420 | | −1.2 |
| 235 | (−) chr 3: 20380459-20380671 | | −1.2 |
| 236 | (+) chr 4: 53395726-53396112 | | −1.2 |
| 237 | (+) chr 19: 9553879-9554314 | | 1.2 |
| 238 | (−) chr 2: 63928103-63928550 | | −1.2 |
| 239 | (+) chr 3: 187581597-187582311 | | −1.2 |
| 240 | (−) chr 5: 76211738-76218598 | | −1.2 |
| 241 | (+) chr 17: 18280923-18281897 | | 1.2 |
| 242 | (−) chr 4: 178566070-178566839 | | −1.2 |
| 243 | (+) chr 12: 60267154-60272981 | | −1.2 |
| 244 | (+) chr 18: 27623185-27623837 | | −1.2 |
| 245 | (−) chr 5: 135094585-135101074 | | −1.2 |
| 246 | (−) chr 10: 4962301-4962771 | | −1.2 |
| 247 | (−) chr 5: 153996685-154003250 | | −1.2 |
| 248 | (−) chr 6: 5981329-5981780 | | −1.2 |
| 249 | (−) chr 8: 828875-829287 | | −1.2 |
| 250 | (+) chr 18: 38295804-38303710 | | −1.2 |
| 251 | (−) chr 3: 54643549-54649271 | | −1.2 |
| 252 | (−) chr 18: 68050597-68051144 | | −1.2 |
| 253 | (−) chr 3: 46260865-46268560 | | −1.2 |
| 254 | (−) chr 21: 40033061-40040223 | | −1.2 |
| 255 | (−) chr 1: 148879269-148880889 | | 1.2 |
| 256 | (−) chr 2: 44343693-44344377 | | 1.2 |
| 257 | (−) chr 11: 80087903-80088662 | | −1.2 |
| 258 | (+) chr 3: 46140179-46140255 | | −1.2 |
| 259 | (+) chr 10: 45388242-45391541 | | −1.2 |
| 260 | (−) chr 10: 52210114-52210776 | | 1.2 |
| 261 | (−) chr 3: 163923299-163927462 | | −1.2 |
| 262 | (−) chr 18: 22761239-22762201 | | −1.2 |
| 263 | (+) chr 5: 64505763-64506756 | | −1.2 |
| 264 | (−) chr 16: 18909966-18916124 | | −1.2 |
| 265 | (+) chr 5: 119114744-119115548 | | −1.2 |
| 266 | (+) chr 1: 69101725-69102525 | | −1.2 |
| 267 | (+) chr 1: 161827723-161832945 | | −1.2 |
| 268 | (+) chr 1: 223140681-223147414 | | −1.2 |
| 269 | (+) chr Y: 26648032-26648192 | | −1.2 |
| 270 | (−) chr 2: 195907646-195913044 | | −1.2 |
| 271 | (−) chr 7: 54710388-54711318 | | −1.2 |
| 272 | (−) chr 8: 34837245-34837699 | | 1.2 |
| 273 | (+) chr 4: 27585609-27586295 | | −1.2 |
| 274 | (+) chr 6: 160569673-160575346 | | −1.2 |
| 275 | (−) chr 2: 167330763-167331232 | | −1.1 |
| 276 | (−) chr 21: 16686151-16692725 | | −1.1 |
| 277 | (−) chr 3: 180722967-180726830 | | −1.1 |
| 278 | (+) chr 13: 61603944-61604298 | | −1.1 |
| 279 | (−) chr Y: 15720288-15724345 | | −1.1 |
| 280 | (−) chr 1: 115355475-115355826 | | 1.1 |
| 281 | (+) chr Y: 26648032-26648192 | | −1.1 |
| 282 | (+) chr 11: 94682231-94690615 | | −1.1 |
| 283 | (−) chr 18: 62088302-62089092 | | 1.1 |
| 284 | (+) chr 19: 49834194-99835177 | | −1.1 |
| 285 | (−) chr 11: 69737702-69743910 | | −1.1 |

The subject of the present invention is therefore a method for the in vitro diagnosis of colon cancer or for the in vitro prognosis of the seriousness of colon cancer in a biological sample taken from a patient, which comprises a step of detecting at least one expression product of at least one nucleic acid sequence, said nucleic acid sequence being chosen from the sequences identified in SEQ ID NOs: 1 to 285 or from the sequences which exhibit at least 99% identity, preferably at least 99.5% identity and advantageously at least 99.6% or at least 99.7% identity with one of the sequences identified in SEQ ID NOs: 1 to 285.

The diagnosis makes it possible to establish whether or not an individual is ill. The prognosis makes it possible to establish a degree of seriousness of the disease (grades and/or stages) which has an effect on the survival and/or quality of life of the individual. In the context of the present invention, the diagnosis may be very early.

The percentage identity described above has been determined by taking into consideration the nucleotide diversity in the genome. It is known that nucleotide diversity is higher in regions of the genome that are rich in repeat sequences than in regions which do not contain repeat sequences. By way of example, Nickerson D. A. et al. (1) have shown a diversity of approximately 0.3% (0.32%) in regions containing repeat sequences.

The ability to discriminate a cancerous state of each of the sequences identified above has been demonstrated by means of a statistical analysis using the SAM procedure (5), followed by correction by means of the rate of false positives (6) and by elimination of the values below $2^6$. Consequently, each of the sequences identified above exhibits a significant difference in expression between a tumor state and a normal state. As a result of this, a difference in expression observed for one of the abovementioned sequences constitutes a signature of the pathological condition. Of course, it is possible to combine the differences in expression noted for several of the sequences referenced above for example by one or more combinations of 2, 3, 4, 5, 6, 7, 8, 9, 10 or even more up to 285 of the listed sequences, preferably by one or more combinations of 2, 3, 4, 5, 6, 7, 8, 9, 10, or even more up to 18 of the sequences respectively identified in SEQ ID NOs: 1, 2, 3, 4, 5, 7, 8, 9, 10, 11, 12, 13, 17, 19, 22, 24, 25, 27 and 97.

In particular, the sequences identified in SEQ ID NOs: 2, 3 and 8, taken alone or in combination (in pairs or all three) constitute one or more preferred signatures.

Thus, in the method of the invention, at least two expression products respectively of at least two nucleic acid sequences are detected, said nucleic acid sequences being chosen from the sequences identified in SEQ ID NOs: 1 to 285 or from the sequences which exhibit at least 99% identity, preferably at least 99.5% identity and advantageously at least 99.6% or at least 99.7% identity with one of the sequences identified in SEQ ID NOs: 1 to 285.

In one embodiment of the method according to the invention, the expression product of at least two nucleic acid sequences is detected, said at least two nucleic acid sequences being chosen from the sequences identified as being specific for colon tissue, i.e. chosen from the group of sequences identified in SEQ ID NOs: 1, 2, 3, 4, 5, 7, 8, 9, 10, 11, 12, 13, 17, 19, 22, 24, 25, 27 and 97 or from the sequences which exhibit at least 99% identity, preferably at least 99.5% identity and advantageously at least 99.6% or at least 99.7% identity with one of the sequences identified in SEQ ID NOs: 1, 2, 3, 4, 5, 7, 8, 9, 10, 11, 12, 13, 17, 19, 22, 24, 25, 27 and 97.

In another embodiment of the method of the invention, the expression product of at least one sequence chosen from the sequences identified as being specific for colon tissue, i.e. chosen from the group of sequences identified in SEQ ID NOs: 1, 2, 3, 4, 5, 7, 8, 9, 10, 11, 12, 13, 17, 19, 22, 24, 25, 27 and 97 or chosen from the sequences which exhibit at least 99% identity, preferably at least 99.5% identity and advantageously at least 99.6% or at least 99.7% identity with one of the sequences identified in SEQ ID NOs: 1, 2, 3, 4, 5, 7, 8, 9, 10, 11, 12, 13, 17, 19, 22, 24, 25, 27 and 97 and the expression product of at least one sequence chosen from the sequences identified as being not specific for colon tissue, i.e. chosen from the group of sequences identified in SEQ ID NOs: 6, 14, 15, 16, 18, 20, 21, 23, 26, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284 and 285 or chosen from the sequences which exhibit at least 99% identity, preferably at least 99.5% identity and advantageously at least 99.6% or at least 99.7% identity with one of the sequences identified in SEQ ID NOs: 6, 14, 15, 16, 18, 20, 21, 23, 26, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 150, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284 and 285, are detected.

In particular, in the method of the invention, the expression product of at least one nucleic acid sequence, preferably of at least two nucleic acid sequences or of three nucleic acid sequences is detected, said nucleic acid sequences being chosen from the group of sequences identified in SEQ ID NOs: 2, 3 and 8, or from the sequences which exhibit at least 99% identity, preferably at least 99.5% identity and advantageously at least 99.6% or at least 99.7% identity with the sequences identified in SEQ ID NOs: 2, 3 and 8.

The expression product detected is at least one RNA transcript, in particular at least one mRNA or at least one polypeptide.

When the expression product is an mRNA transcript, it is detected by any appropriate method, such as hybridization, sequencing or amplification. The mRNA may be detected directly by bringing into contact with at least one probe and/or at least one primer which are designed so as to hybridize to the mRNA transcripts under predetermined experimental conditions, demonstrating the presence or the absence of hybridization to the mRNA and optionally quantifying the mRNA. Among the preferred methods, mention may be made of amplification (for example, RT-PCR, NASBA, etc.), hybridization on a chip or else sequencing. The mRNA may also be detected indirectly using nucleic acids derived from said transcripts, such as cDNA copies, etc.

Generally, the method of the invention comprises an initial step of extracting the mRNA from the sample to be analyzed.

Thus, the method may comprise:
(i) a step of extracting the mRNA from the sample to be analyzed,
(ii) a step of detecting and quantifying the mRNA from the sample to be analyzed,
(iii) a step of extracting the mRNA in a reference sample, which may be a healthy sample originating in the same individual, or
(iv) a step of detecting and quantifying the mRNA from the healthy sample,
(v) a step of comparing the amount of mRNA expressed in the sample to be analyzed and in the reference sample; it being possible for the determination of an amount of mRNA expressed in the sample to be analyzed which is different than the amount of mRNA expressed in the healthy reference sample to be correlated with the diagnosis or the prognosis of the seriousness of colon cancer (the difference in the amount of mRNA in the cancerous colon tissue relative to the amount of mRNA expressed in the healthy colon tissue being indifferently an expression, an overexpression or an underexpression);
and in particular:
(i) an extraction of the mRNA to be analyzed from the sample,
(ii) a determination, in the RNA to be analyzed, of an expression level of at least one RNA sequence in the sample, preferably of at least two RNA sequences in the sample, the RNA sequence and the RNA sequences being respectively the transcription product of at least one nucleic acid sequence and of at least two nucleic acid sequences chosen from the sequences identified in SEQ ID NOs: 1 to 285 or from the sequences which exhibit at least 99% identity, preferably at least 99.5% identity and advantageously at least 99.6% or at least 99.7% identity with one of the sequences identified in SEQ ID NOs: 1 to 285, and
(iii) a comparison of the expression level of the RNA sequence(s) defined in (ii) with a reference expression level; it being possible for the determination of an expression level of the RNA to be analyzed which exhibits a difference relative to the reference expression level to be correlated with the diagnosis or the prognosis of colon cancer (as determined above); or
(i) a step of extracting the mRNA from the sample to be analyzed,
(ii) a step of detecting and quantifying the mRNA from the sample to be analyzed,
(iii) a step of comparing the amount of mRNA expressed in the sample to be analyzed relative to an amount of reference mRNA, it being possible for the determination of an amount of mRNA expressed in the sample to be analyzed which is different than the amount of reference mRNA to be correlated with the diagnosis or the prognosis of colon cancer (the difference in the amount of mRNA in the sample to be analyzed relative to the amount of reference mRNA being indifferently an expression, an overexpression or an underexpression).

In one embodiment of the method of the invention, DNA copies of the mRNA are prepared, the DNA copies are brought into contact with at least one probe and/or at least one primer under predetermined conditions which allow hybridization, and the presence or absence of hybridization to said DNA copies is detected.

The expression product which is detected may also be a polypeptide which is the translation product of at least one of the transcripts described above. In this case, the polypeptide expressed is detected by bringing into contact with at least one specific binding partner of said polypeptide, in particular an antibody or an antibody analog or an aptamer. The binding partner is preferably an antibody, for example a monoclonal antibody or a polyclonal antibody which is highly purified or an antibody analog, for example an affinity protein with competitive properties (Nanofitin™).

The polyclonal antibodies can be obtained by immunization of an animal with the appropriate immunogen, followed by recovery of the desired antibodies in purified form, by taking the serum of said animal, and separation of said antibodies from the other serum constituents, in particular by affinity chromatography on a column to which an antigen specifically recognized by the antibodies is bound.

The monoclonal antibodies can be obtained by means of the hybridoma technology, the general principle of which is summarized below.

Firstly, an animal, generally a mouse, is immunized with the appropriate immunogen, and the B lymphocytes of said mouse are then capable of producing antibodies against this antigen. These antibody-producing lymphocytes are then fused with "immortal" myeloma cells (murine in the example) so as to give rise to hybridomas. The cells capable of producing a particular antibody and of multiplying indefinitely are then selected from the heterogeneous mixture of cells thus obtained. Each hybridoma is multiplied in the form of a clone, each one resulting in the production of a monoclonal antibody in which the properties of recognition with respect to the protein may be tested, for example, by ELISA, by one-dimensional or two-dimensional Western blotting, by immunofluorescence, or using a biosensor. The monoclonal antibodies thus selected are subsequently purified, in particular according to the affinity chromatography technique described above.

The monoclonal antibodies may also be recombinant antibodies obtained by genetic engineering, using techniques well known to those skilled in the art.

Nanofitins™ are small proteins which, like antibodies, are capable of binding to a biological target, thus making it possible to detect it, to capture it or quite simply to target it within an organism. They are presented, inter alia, as antibody analogs.

Aptamers are synthetic oligonucleotides capable of binding a specific ligand.

The invention also relates to the use of at least one nucleic acid sequence, which has been isolated, as a molecular marker for the in vitro diagnosis or prognosis of colon cancer, characterized in that said nucleic acid sequence consists of:
(i) at least one DNA sequence chosen from the sequences SEQ ID NOs: 1 to 285, or
(ii) at least one DNA sequence complementary to a sequence chosen from the sequences SEQ ID NOs: 1 to 285, or
(iii) at least one DNA sequence which exhibits at least 99% identity, preferably at least 99.5% identity and advantageously at least 99.6% or at least 99.7% identity with a sequence as defined in (i) and (ii), or
(iv) at least one RNA sequence which is the transcription product of a sequence chosen from the sequences as defined in (i), or
(v) at least one RNA sequence which is the transcription product of a sequence chosen from the sequences which exhibit at least 99% identity, preferably at least 99.5% identity and advantageously at least 99.6% or at least 99.7% identity with a sequence as defined in (i).

In one embodiment, use is made of at least two nucleic acid sequences which consist of:
(i) at least two DNA sequences chosen from the sequences SEQ ID NOs: 1 to 285, preferably chosen from the sequences identified in SEQ ID NOs: 1, 2, 3, 4, 5, 7, 8, 9, 10, 11, 12, 13, 17, 19, 22, 24, 25, 27 and 97 and in particular the sequences SEQ ID Nos: 2, 3 and 8, or
(ii) at least two DNA sequences respectively complementary to at least two sequences chosen from the sequences SEQ ID Nos: 1 to 285, preferably chosen from the sequences identified in SEQ ID NOs: 1, 2, 3, 4, 5, 7, 8, 9, 10, 11, 12, 13, 17, 19, 22, 24, 25, 27 and 97 and in particular chosen from the sequences SEQ ID NOs: 2, 3 and 8, or
(iii) at least two DNA sequences which exhibit respectively at least 99% identity, preferably at least 99.5% identity and advantageously at least 99.6% or at least 99.7% identity with two sequences as defined in (1) and (ii), or
(iv) at least two RNA sequences which are respectively the transcription product of two sequences chosen from the sequences as defined in (i), or
(v) at least two RNA sequences which are the transcription product of two sequences chosen from the sequences which exhibit at least 99% identity, preferably at least 99.5% identity and advantageously at least 99.6% or at least 99.7% identity with the sequences as defined in (i).

A subject of the invention is also a kit for the in vitro diagnosis or prognosis of colon cancer in a biological sample taken from a patient, which comprises at least one specific binding partner of at least one expression product of at least one nucleic acid sequence chosen from the sequences identified in SEQ ID NOs: 1 to 285 or from the sequences which exhibit at least 99% identity, preferably at least 99.5% identity, advantageously at least 99.6% or at least 99.7% identity with the nucleic acid sequences identified in SEQ ID NOs: 1 to 285 and no more than 285 specific binding partners of the expression products of the nucleic acid sequences identified in SEQ ID NOs: 1 to 285 or of the nucleic acid sequences which exhibit at least 99% identity with the nucleic acid sequences identified in SEQ ID NOs: 1 to 285, preferably at least 99.5% identity and advantageously at least 99.6% or at least 99.7% identity with one of the sequences identified in SEQ ID NOs: 1 to 285.

In one embodiment, the kit comprises at least two respectively specific binding partners of at least two expression products of at least two nucleic acid sequences chosen from the sequences identified in SEQ ID NOs: 1 to 285 or from the sequences which exhibit at least 99% identity, preferably at least 99.5% identity and advantageously at least 99.6% or at least 99.7% identity with the nucleic acid sequences identified in SEQ ID NOs: 1 to 285 and no more than 285 specific binding partners of the expression products of the nucleic acid sequences identified in SEQ ID NOs: 1 to 285 or of the nucleic acid sequences which exhibit at least 99% identity, preferably at least 99.5% identity and advantageously at least 99.6% or at least 99.7% identity with the nucleic acid sequences identified in SEQ ID NOs: 1 to 285.

For example, the kit comprises at least two respectively specific binding partners of the expression product of at least two nucleic acid sequences chosen from the group of sequences identified in SEQ ID NOs: 1, 2, 3, 4, 5, 7, 8, 9, 10, 11, 12, 13, 17, 19, 22, 24, 25, 27 and 97 or of the sequences which exhibit at least 99% identity with the sequences identified in SEQ ID NOs: 1, 2, 3, 4, 5, 7, 8, 9, 10, 11, 12, 13, 17, 19, 22, 24, 25, 27 and 97.

In particular, the kit comprises 2 or 3 respectively specific binding partners of the expression products of the nucleic acid sequences identified in SEQ ID NOs: 2, 3 and 8 or of the sequences which exhibit at least 99% identity, preferably at least 99.5% identity and advantageously at least 99.6% or at least 99.7% identity with the sequences identified in SEQ ID NOs: 2, 3 and 8.

The at least specific binding partner of the expression product corresponds to the definitions given above.

The invention also relates to a method for evaluating the efficacy of a treatment and/or a progression in colon cancer, which comprises a step of obtaining a series of biological samples, and a step of detecting at least one expression product of at least one nucleic acid sequence in said series of biological samples, said nucleic acid sequence being chosen from the sequences identified in SEQ ID NOs: 1 to 285 or from the sequences which exhibit at least 99% identity, preferably at least 99.5% identity and advantageously at least 99.6% or at least 99.7% identity with the sequences identified in SEQ ID NOs: 1 to 285.

In one embodiment, at least two expression products of at least two nucleic acid sequences are detected, said two nucleic acid sequences being chosen from the sequences identified in SEQ ID NOs: 1 to 285 or from the sequences which exhibit at least 99% identity respectively, preferably at least 99.5% identity and advantageously at least 99.6% or at least 99.7% identity with the sequences identified in SEQ ID NOs: 1 to 285.

In another embodiment of the method, the expression product of at least one nucleic acid sequence, preferably of at least two nucleic acid sequences or of three nucleic acid sequences is detected, said nucleic acid sequences being chosen from the group of sequences identified in SEQ ID NOs: 2, 3 and 8 or from the sequences which exhibit at least 99% identity respectively, preferably at least 99.5% identity and advantageously at least 99.6% or at least 99.7% identity with the sequences identified in SEQ ID NOs: 2, 3 and 8.

The term "biological sample" is intended to mean a tissue, a fluid, components of said tissue and fluid, such as cells or apoptotic bodies, and excreted vesicles, comprising in particular exosomes and microvesicles. By way of example, the biological sample may be derived from a biopsy of the colon carried out beforehand in a patient suspected of suffering from colon cancer or may be derived from a biopsy carried out on an organ other than the colon in a patient presenting metastases. In this second case, when the change in expression of the nucleic acid (molecular marker) is specific for the colon organ, it is possible to work back to the primary cancer, i.e. to colon cancer. The biological sample may also be a biological fluid, such as blood or a blood fraction (serum, plasma), urine, saliva, cerebrospinal fluid, lymph, maternal milk, sperm, and also components of said fluids, in particular excreted vesicles as defined above. For example, the detection of a transcript specific for the colon tissue in an exosome or a microvesicle, originating from an epithelial cell, is a sign of the presence either of a primary cancer or of metastases, without it being necessary to take a sample at the level of the organ.

FIGURES

FIGS. 1 and 2 represent the differential expression observed in colon cancer for a set of HERV sequences. More specifically, FIG. 1 (clustering) groups together in an exploratory manner the HERV elements which have an expression tropism associated with colon cancer compared with all the control tissues, and FIG. 2 shows the statistical differences in expression of HERV elements between normal colon and tumoral colon.

EXAMPLES

Example 1

Identification of HERV Sequences Exhibiting Differential Expression in Colon Cancer Method:

The identification of HERV sequences exhibiting differential expression in colon cancer is based on the design and the use of a high-density DNA chip in the GeneChip format, called HERV-V2, designed by the inventors and the fabrication of which was subcontracted to the company Affymetrix. This chip contains probes which correspond to HERV sequences that are distinct within the human genome. These sequences were identified using a set of prototypical references cut up into functional regions (LTR, gag, pol and env), and then, by means of a similarity search on the scale of the whole human genome (NCBI 36/hg18), 10 035 distinct HERV loci were identified, annotated and finally grouped together in a databank called HERV DB3.

The probes which are part of the composition of the chip were defined on the basis of HERVgDB3 and selected by applying a hybridization specificity criterion, the objective of which is to exclude, from the creation process, the probes having a high risk of hybridization with an undesired target. For this, the HERVgDB3 sequences were first segmented in sets of 25 overlapping nucleotides (25-mers), resulting in a set of candidate probes. The risk of nonspecific hybridization was then evaluated for each candidate probe by performing alignments on the whole of the human genome using the KASH algorithm (2). An experimental score marks the result of the hybridization, addition of the impact of the number, of the type and of the position of the errors in the alignment. The value of this score correlates with the target/probe hybridization potential. Knowledge of all the hybridization potentials of a candidate probe on the whole of the human genome makes it possible to evaluate its capture specificity. The candidate probes which exhibit good capture affinity are retained and then grouped together in "probe sets" and, finally, synthesized on the HERV-V2 chip.

The samples analyzed using the HERV-V2 high-density chip correspond to RNAs extracted from tumors and to RNAs extracted from the healthy tissues adjacent to these tumors. The tissues analyzed are the colon, with breast, ovary, uterus, prostate, lung, testicle and placenta as controls. In the case of placenta, only healthy tissues were used. For each sample, 50 ng of RNA were used for the synthesis of cDNA using the amplification protocol known as WTO. The principle of WTO amplification is the following: random primers, and also primers targeting the 3' end of the RNA transcript, are added, before a step of reverse transcription followed by a linear, single-stranded amplification denoted SPIA. The cDNAs are then assayed, characterized and purified, and then 2 µg are fragmented, and labeled with biotin at the 3' end via the action of the terminal transferase enzyme. The target product thus prepared is mixed with control oligonucleotides, then the hybridization is carried out according to the protocol recommended by the company Affymetrix. The chips are then visualized and read in order to acquire the image of their fluorescence. A quality control based on standard controls is carried out, and a set of indicators (MAD, MAD-Med plots, RLE) serve to exclude the chips that are not in accordance with a statistical analysis.

The analysis of the chips first consists of a preprocessing of the data through the application of a correction of the background noise based on the signal intensity of tryptophan probes, followed by RMA normalization (3) based on the quantile method. A double correction of the effects linked to the batches of experiments is then carried out by applying the COMBAT method (4) in order to guarantee that the differences in expression that are observed are of biological and not technical origin. At this stage, an exploratory analysis of the data is conducted using tools for grouping together data by Euclidean partitioning (clustering) and, finally, a statistical analysis using the SAM procedure (5) followed by a correction via the rate of false positives (6) and elimination of the values below $2^6$ is applied in order to search for sequences exhibiting a differential expression between the normal state and the tumor state of a tissue.

Results:

The processing of the data generated by the analysis of the HERV-V2 DNA chips using this method made it possible to identify a set of "probe sets" exhibiting a statistically significant difference in expression between the normal colon and the tumoral colon. The results of the clustering and also the search for differential expression within the control samples moreover demonstrated HERV elements of which the differential expression is specifically associated with the tumoral colon.

The nucleotide sequences of the HERV elements exhibiting a differential expression in the tumoral colon are identified by SEQ ID NOs: 1 to 285, the chromosomal location of each sequence is given in the NCBI reference 36/hg18, and the "target tissue" information (a cross) indicates the elements in which the differential expression was observed only in the comparison between normal colon and tumoral colon (compared with the comparisons within the control tissues). A value which is an indication of the ratio of expression between normal state and tumor state is also provided, and serves to order the sequences in the interests of presentation only.

Example 2

Detection of HERV Sequences in Biological Fluids

Principle:

The inventors have shown that HERV sequences are detected in biological fluids, which makes it possible, inter alia, to characterize a colon cancer through recourse to remote detection of the primary organ. A study was carried out on 20 urine samples and 38 serum samples originating from different individuals.

The sera and the urines were centrifuged under the following conditions:

Sera: 500 g for 10 minutes at 4° C. The supernatant was recovered and centrifuged again at 16 500 g for 20 minutes at 4° C. The supernatant of this second centrifugation, devoid of cells, but also comprising exosomes, microvesicles, nucleic acids and proteins, was analyzed on chips. The chip is the HERV-V2 chip used according to the modes previously described.

Urines: after collection, centrifugation at 800 g for 4 minutes at 4° C. The pellet was recovered with RNA protect cell Reagent™. Then, centrifugation at 5000 g for 5 minutes before addition of the lysis buffer to the pellet. The chip is the HERV-V2 chip used according to the modes previously described.

Figure 1:
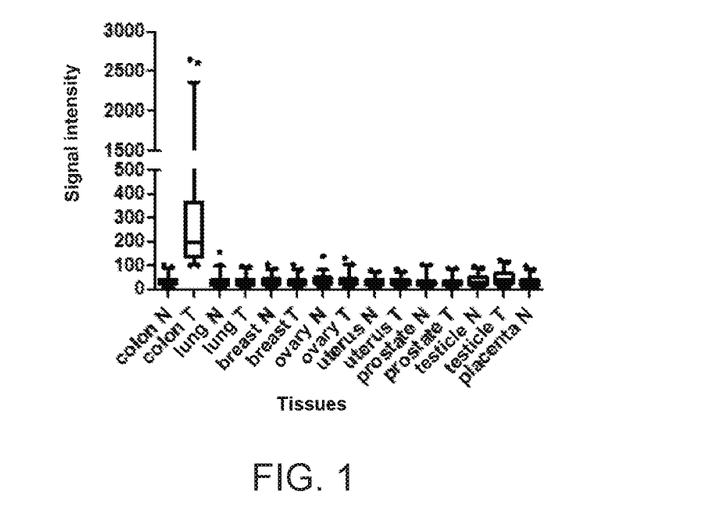
Figure 2:
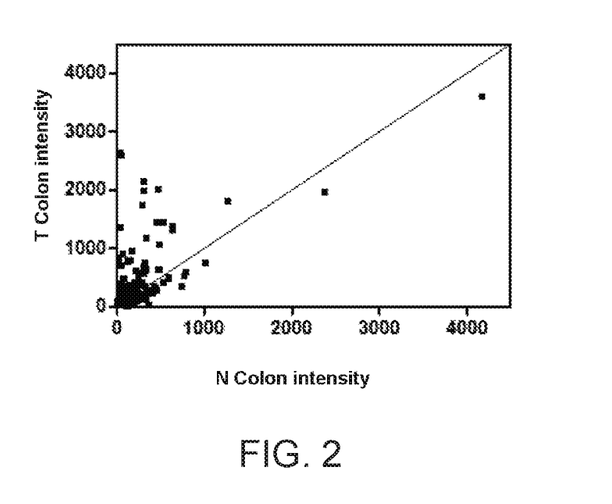
Figure 3:
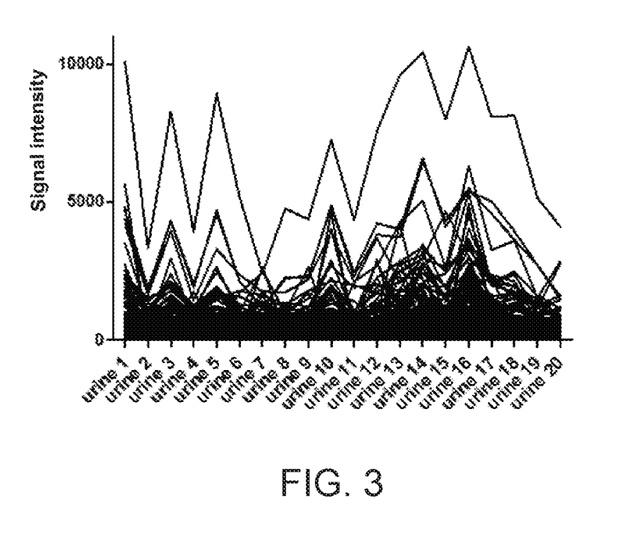
FIGS. 3 and 4 show the detection of HERV sequences in two biological fluids: urines and sera.
Figure 4:
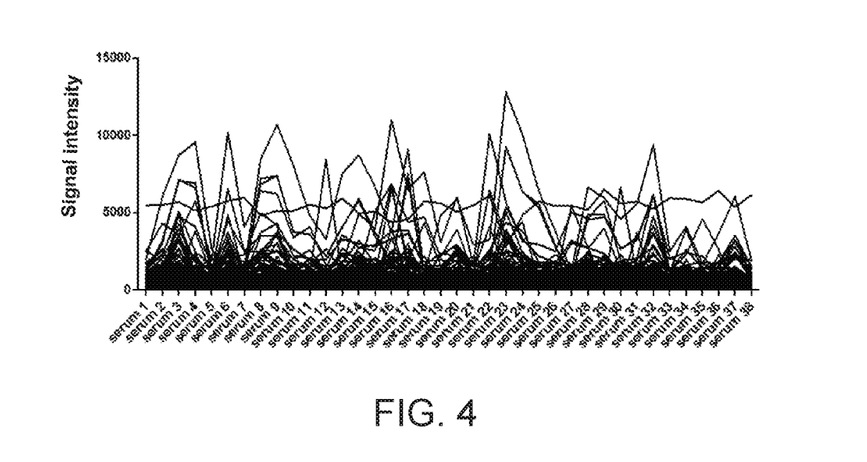

Results:

A large number of positive signals, including the expression signals corresponding to the sequences listed in the table above, was detected both in the serum supernatants and in the cell pellets originating from urines, as illustrated in FIGS. 3 and 4. This confirms that biological fluids, in particular serum and urine, are a usable source of biological material for the detection of HERV sequences. It is commonly accepted that the positivity threshold is about $2^6$, i.e. 64.

Example 3

Demonstration of the Advantage of a Combination of Two, and Three, HERV Sequences for the Detection of Colorectal Cancer Method:

RNAs originating from 28 colon tumors (CT1, CT2, CT3, CT65, CT94, CC1, CC2, CC3, CC4, CC5, CC6, CC7, CC8, CC9, CC10, 549T, 551T, 553T, 556T, 558T, 559T, 560T, 561T, 601T, 602T, 604T, 607T and 615T) and from 18 healthy colon tissues (CN1, CN2, CN3, CN64, CN93, 549N, 551N, 553N, 556N, 558N, 559N, 560N, 561N, 601N, 602N, 604N, 607N and 615N) were extracted and used to demonstrate that the combination of the results of expression of two, or three, HERV sequences makes it possible to increase the number of detections within colorectal tumor samples.

Figure 5:
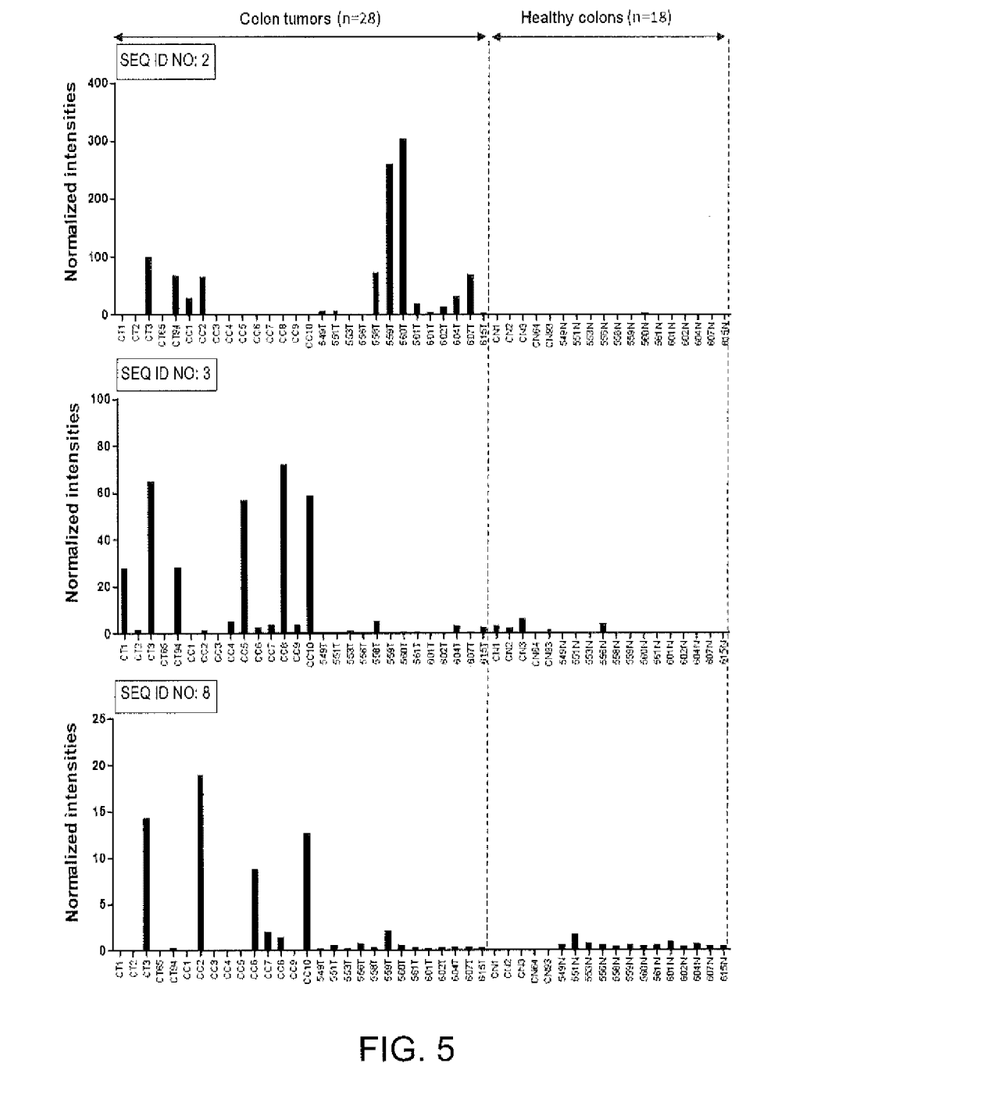
FIG. 5 presents the expression results obtained by quantitative RT-PCR on the sequences SEQ ID NO: 2, SEQ ID NO: 3 and SEQ ID NO: 8, for 28 colon tumors and 18 healthy colon tissues, and in particular demonstrates the advantage of combining them in order to increase the number of detections within colorectal tumor samples.

A quantitative RT-PCR amplification corresponding to the regions 1723-1824 of SEQ ID NO: 2, 1540-1665 of SEQ ID NO: 3 and 1684-1923 of SEQ ID NO: 8 was carried out for all of the 46 samples of the study. The HERV sequence expression results were processed using the delta Ct method and normalized by means of the results of expression of the GAPDH housekeeping gene. The results are presented in FIG. 5.

Results:

The quantitative RT-PCR amplification of the region 1723-1824 of SEQ ID NO: 2 is positive for 11 colon tumor samples (CT3, CT94, CC1, CC2, 558T, 559T, 560T, 561T, 602T, 604T and 607T). No detection of this region is observed for the healthy colon tissue samples.

The quantitative RT-PCR amplification of the region 1540-1665 of SEQ ID NC: 3 is positive for 6 colon tumor samples (CT1, CT3, CT94, CC5, CC8 and CC10). No detection of this region is observed for the healthy colon tissue samples.

The quantitative RT-PCR amplification of the region 1684-1923 of SEQ ID NO: 8 is positive for 4 colon tumor samples (CT3, CC2, CC6 and CC10). No detection of this region is observed for the healthy colon tissue samples.

Taking into account, in an additive manner, the detections of the region 1723-1824 of SEQ ID NO: 2 and of the region 1540-1665 of SEQ ID NO: 3 allows coverage of 15 colon tumor samples (CT1, CT3, CT94, CC1, CC2, CC5, CC8, CC10, 558T, 559T, 560T, 561T, 602T, 604T and 607T), thus showing a gain in sensitivity of this combination of two HERV sequences compared with the use of these same HERV sequences considered in isolation.

Taking into account, in an additive manner, the detections of the region 1723-1824 of SEQ ID NO: 2 and of the region 1684-1923 of SEQ ID NO: 8 allows coverage of 13 colon tumor samples (CT3, CT94, CC1, CC2, CC6, CC10, 558T, 559T, 560T, 561T, 602T, 604T and 607T), thus showing a gain in sensitivity of this combination of two HERV sequences compared with the use of these same HERV sequences considered in isolation.

Taking into account, in an additive manner, the detections of the region 1540-1665 of SEQ ID NO: 3 and of the region 1684-1923 of SEQ ID NO: 8 allows coverage of 8 colon tumor samples (CT1, CT3, CT93, CC2, CC5, CC6, CC8 and CC10), thus showing a gain in sensitivity of this combination of two HERV sequences compared with the use of these same HERV sequences considered in isolation.

Finally, taking into account, in an additive manner, the detections of the region 1723-1824 of SEQ ID NO: 2 and of the region 1540-1665 of SEQ ID NO: 3 and of the region 1684-1923 of SEQ ID NO: 8 allows coverage of 16 colon tumor samples (CT1, CT3, CT94, CC1, CC2, CC5, CC6, CC8, CC10, 558T, 559T, 560T, 561T, 602T, 604T and 607T), thus showing a gain in sensitivity of this combination of three HERV sequences compared with the use of these same HERV sequences considered in isolation or in combination in pairs.

LITERATURE REFERENCES

1. Nickerson, D. A., Taylor, S. L., Weiss, K. M., Clark, A. G., Hutchinson, R. G., Stengard, J., Salomaa, V., Vartiainen, E., Boerwinkle, E. and Sing, C. F. (1998) DNA sequence diversity in a 9.7-kb region of the human lipoprotein lipase gene. *Nat. Genet.*, 19, 233-240.
2. Navarro, G. and Raffinot, M. (2002) Flexible Pattern Matching in Strings: Practical On-Line Search Algorithms for Texts and Biological Sequences. Cambridge University Press.
3. Irizarry, R. A., Hobbs, B., Collin, F., Beazer-Barclay, Y. D., Antonellis, K. J., Scherf, U. and Speed, T. P. (2003) Exploration, normalization, and summaries of high density oligonucleotide array probe level data. *Biostatistics (Oxford, England)*, 4, 249-264.
4. Johnson, W. E., Li, C. and Rabinovic, A. (2007) Adjusting batch effects in microarray expression data using empirical Bayes methods. *Biostatistics (Oxford, England)*, 8, 118-127.
5. Tusher, V. G., Tibshirani, R. and Chu, G. (2001) Significance analysis of microarrays applied to the ionizing radiation response. *Proceedings of the National Academy of Sciences of the United States of America*, 98, 5116-5121.
6. Storey, J. D. and Tibshirani, R. (2003) Statistical significance for genomewide studies. *Proceedings of the National Academy of Sciences of the United States of America*, 100, 9440-9445.

SEQUENCE LISTING (285 sequences)

SEQ ID NO: 1 - DNA, 7574 bp, Homo sapiens
tgtggtcagaattcttacacaagagccaggaccgcaccctgtagcctttctgtgcaaacaacttgaccttactgttttagcctagccctcatgtctgcctgcagcggctgctgctgctttaatacttttagaggccctcaaaatccccaactatgctcaactcactgtacagttctcataacttccaaaatctattttcttcttcatacctgacgcatatactttctgcttcccggctccttcagctatactcactcttttctgagtctcccacaattatcattgttcctggcccagacttcaatccggcctcccacattattcctgataccacacctgacccccatgactgtatctctctgatccacctgacattcaccccatttccccaaatttccttctttcctcttcctcaccctgatcatgcttgatttattgatggcggttccaccaggcctaatcgccacacaccagcaaaggcaggttatgctatagtacaagccactagcctgcctcttagaacctctcatttcttttccatcgtggaaatctaccctcaaggaaataacttctcagtgttccatctgctattctactactcctcagggattattcaggccccctcccttccctacacatcaagctcgaggatttgcccccacccaggactggcaaattagctttactcaacatgcccaagtcaggaaactaaaataccccttagtctaaatagacacttccactgaataagtaaaggcctttcgtacagggtctgagaaggccacggcagtcatttattcccttctgtcagacataattcctcagtttagccttcccacctcaatacagtctgataacagacgagcctttattagtcaaatcagccaagcagtttttcaggctcttagtattcagtgaaacctttatatcccttaaggtcctccatcttcaagaaaagtagaatggactaaaggtcttttaaaaacacgcctcaccaagctcagccaccaacttaaaaaggactggacaatacttctaccactttcccttctcagaattcaggcctgtcagaatgctacagggtacagcccatttaagctcctgtatagacgctcctttttattaggccccagtctcattccagacaccagaccaacttagactgtgcccccctcccaaaaaaaacttgtcatccctactattttctgtctagtcatactcctattaccattctcaactactcatacatgccctgctcttctttacactgccggtttacactgtttctccaagccatcacagctgatatctcctggtgctatccccaaactgccactcttaactcttgaagtaaataaataatctttgctggcaggactctgctgaatctccttaggcactctctaatcagatatcctaggtcctcccaattcttagaccttttatacctgtttttctccttctgttattccatttagtttctcaattcatacaaaaccgtatccaggccatcaccaatcattctatatgacaaatgtttcttctaacatccccacaatatcaccccttaccacaagacctcccttcagcttaatctctcccactctaggttcccacgctgcccctaatcccacttgaagcagccctgagaaacatcgcccattctctctccctaccacccctcaaaaattttcaccaccccaacacttcaacactattttgttttatttttcttattaatataagaaggcaggaatgtcaggcctttgagcccaatccaagacatcgcatcccctgtgacttgcacgtatatgcccagatggcctgaagtaactgaagaatcacaaaagaagtgaaaaggccctaccctgtgttaactgatgtcattccaccattgtgatttgttcctgccccaccttaactgaatgattaaccctgtgaatttccttctcctggctcagaagctcccccactgagcaccttgtgacccccgcccctgcccaccagagaacaacccccttttactgtaattttccattaccttcccaaatcctataaaatggcctcacccctatctccctttgctgactctcttttcggactcagcccacctgcacacaggtgattaaaagctttattgctcacacaaagcctgtttggtggtctcttcacacagatgcgcatgaaaataaggatgcccacattcatcatttctattcaacatagtaccagaagtcctagccagagcaacaagacaagagaaagagataaaaggcatccaaattgaagagaaaaacgtcaaaacgttcctgtttgcagacaacatgatcttagagacggaaaaccctaaagactccaccaaaacctgttataattaataaacaaatttagtaaagtagcaggatacaaaatcaacttacgataatcagtagtatttttagatggcattattaagctatctttaaaaatcaagaaaaaaatctcatttacagtacaatagcacaaaaaataagattcctaagaataaacctaaccaagaaggtgaaaaatatctacaacaaaaactataaaacattgatgaaaaatggaagaggacacaaataaatagaaggatacagaaaaatacccccatgttcattgatttaaagaattggaattgttaaagtgtccatactacccaaaacaatctagagattcaatgtaatagctatcaaaatatccatgatattcttcatagaaatagaaagaaaaatcctaaaatgtgtatggaaccacaaaagaccccaaatagccaaatcaatcttaagcaaacagaaccaagctagagggatcacatacctggcttcaaaatgtactacaaagctgtaataaccaaaatagcatggtagtggcataaaaacaggcatatacaccaagggactagaatacagttagaaataaatccacagacttacaaccaactgattttcaacatagatgccaaaaatacacgttggggaaagggcaatcacttcaataaatagtgtggaggaaactgagtatgtacatgcagacatggaactagacccctatctctcaccatatgcaaaaattaactcaaaatggattaaaacttaaatataatgtcaggtctctgagcccaagccaagccatcgcatcccctgtgacttgcatgtatacgcccagatggcctgacgtaactgaagaatcacaaaagaagtgaaaaggtcctgccccgccttaactgatgacattccaccattgtgatttgttcctgccccaccttaactgattaaccctgtgaatcattctcctggctcagaagctccccaagtgagcaccttgtggccccagcccctgcccaccagagaacaaccccctttgactgtaattttcctttacctacccaaatcctataaaacagccccacccttaactccctttgctgactctcttttcggactcagcccacctgtacccaggtgaaataaacagccatgttgctcacacaaagcctgtttggtgatctcttcacacggacgcgcatgaaatttggagacatgactcggatcgggggacctcccttgggagatcaataccctgtcctcttgttctttgctccatgagaaagatccaccaatgacctcaggtcctcagaacaaccagcctgagaaacatctcaccaatttcaaatccggtaagcagcctctttttactctcttctccaacctccctcactatccctcaacctctttctcctttcaatcttggccccacatttctatctctcccttctcttaatttcaattcctttcaattcttttggtagagacaaaggagacacgttttatccgtggacccaaaactctggcaccggtcacggactgggaaggcagccttcccttggtgtttaatcattgcagggacacctctctgattattcacccacgtttcaaaggtgtcagaccatgcagggacacctgccttggtccttcacccttagcagcaagtcccatttttctggggcaggggcaagtacccctcaaccccttctccttcacccttagcagcaagtcccgctttcctggggcaggggcaagtacccctcaaccccttctccttcacccttagtggcaagtcccgctttcctagggggcaagaaccccccaatcacttatttccacaccccaacctcttatctctgcaccccaatcccttatttctgcaccctgacctcttatctctgtgccccaatcccttatttccacgccccaacctcttatatctctgcaccccaatcccttatttctgcaccctgatctatctctgtgccccaaccccttttctggaaggtgagaacacctgaaccacttccctccatttctctactctctcttttctctaggtttgcttccttcactatgggcaaccttccaccctccattcctccttctactcccttggcctgtgttctcaaaaacttaaaacctcttcaactcacacctgacctaaaacttaaacgccttattttcttctgcaatgctgcttgaccccaatacaaactcaacagtagttccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgcccagtgcaactcgtcccaaatcttccttctttccctcccacctgtcccctcagtaccaaccccaagcgtcgctgagtctttctaatcttccttttctacagacccatctgacctctcccttcttccccaggctgctcctcgccaggccgagctaggtcccaattcttcctcagcctctgctcctccaccctataatctttttaccacctctcccctcctcacacctggtctggctcacagtttcattccatgactagccctcctccacctgcccagcaatttactcttaaaaaggtggctggagctaaaggcatagtcaaggttaatgctcctttttctttatcccaaatcagaagtgtttaggctctgtttcatcaaatataaaaatccagcccagttcatggctcatttggcagcaaccctgagacactttacagtcttagaccctaaaaggtcaaaaggccgtcttattctcaaaatacattttattacccaatctgctcctgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaacgcctgaactgcagtggccacgcgttcctccagaacctcctcccataggagcttgcttcgtgtgccagaaatctggccactgggccaaggaatgcccgcagcccgggattcctcctaatccacgtcccatctctgtgggaccccactgaaaatcggactgttcaactcacctggaagccactcccagagcccctggaacactggccaaaggctctctgactgactccttcccagatcttcttggcttagcagctgaagactgacactgcccgatcacctcagaagcacccttgaccatcacggatgccgagctatgggtaactctcacagtggaaggtaagcccgtccccttcttaatcaatacggaggctacccacgccacattaccttcttttcaagggcctgtttcccttgcctccataactgttgtgggtattgacggccaggcttctaaacctcttaaaactccccaactctggtgccaacttagacaatactcttttaagcactcctttttagttatccccatctgcccagttcccttattaggctgagacactttaactaaattatctgcttccctgactattcctggactacagctgtatctcattgccacccttcttcccaatccaaagcctcctttgtgtcctcctcttgtatacccccaccttaacccacaagtataagatatctctactccctccttgacgaccgatcatgcaccccttaccatctcattaaaacctaatcacccttaccgcactcaatgccagtatcccattccgcagcacgctttaaaaagattaaagcctgttatcattcgcctgttacagcatggccttttaaaccctataaactctccttacaattcccccatttttcctgtcctaaaacgagacaagccttacaagttagttcaggatctgcaccttatcaaccaaattgttttgcctatccaccccgtggtgccaaacccatatactctcctatcctcaatacctccctctactacccattattctgttctggatctcagacatgctttctttactattgctttgcacccttcatcccagcctctctttgccttcacttagactgaccctgacacccattaggctcaacaaattacctgggctgcactgccacaaggcttcacagacagcccccattacttcagtgaagcccaaatttcatcctcatctgttagtcatactcctgttcaccgttctcaactactcatacatgccctgctcttctttacactgccggtttacactgtttctccaagacatcacagctgatatctcctggtgctatccccaaactgccactctaaactcttgaagtaaataaataatctttgctggcaggactctgctgaatctccttaggcactctctaatcagatatcctaggtcctcccaattcttagaccttttatacctgtttttctccttctgttattccatttagtttctcaattcatacaaaaccgtatccaggccatcaccaatcattctatatgacaaatgtttcttcttacatccccacaatatcaccctttaccacaagacctcccttcagcttaatctctcccactctagattcccacgctgcccctaatcccacttgaagcagccctgagaaacatcgcccattctctctccctaccacccctcaaaaattttcaccaccccaacacttcaacactattttgttttatttttcttattaatataagaaggcaggaatgtcaggcctctgagcccaagccaagccatcgcattccctgtgacttgcacgtatacgcccagatggcctgaagtaactgaagaatcacaaaagaagtgaaaaggtcctgccccaccttaactgatgatattccaccattgtgatttgttcctgccccaccttaactgagtgattaaccctgtgaattgttctcctggctcagaagctccccaactgagcaccttgtgacccccacccctgcccaccagagaacaacccccttttactgtaattttcctttaccaacccaaatcctataaaatggccccacccctatctcccttcgctgactctctttttggactcagcccgcctgcacccaggtgaaataaacagccatgttgctcaaacaaagcctgtttggtggtctcttcacacggatgtgcatgaaa

SEQ ID NO: 2 - DNA, 5846 bp, Homo sapiens
gtcaggcctctgagcccaagccaagccatcgcatcccctgtgacttgcatgtatacgcccagatggcctgaagtaactgaagaatcacaaaagaagtgaatatgccctgccccaccttaactgatgacattccaccattgtgatttgttcctgccccaccctaactgatcaatgtactttgtaatctcccccacccttaagaaggtcctttgtaattctccccacccttgagaatgtactttgtgagatccacccctgcccaccagagaacaaccccctttgactgtaattttccattaccttcccaaatcctataaaacggccccacccctatctccctttgctgactctcttttcggactcagcccgcctgcacccaggtgaaataaacagccatgttgctcacacaaagcctgtttggtggtctcttcacatggacgcacatgaaatttggtgccatgactcggatcgggggacctcccttgggagatcaatcctccgtcctcctgctctttgctccctgagaaagatccacctacgacctcaggtcctcagaccgacgagcccaagaaacatctcaccaatttcaaatctggtaagcagcctctttttactctcttctccaacttccctcactatccctcaaccactttctcctttcaatcttggcactacacttcaatctctcccttctcttaatttcaattcctttcattttctggtagagacaaaagagacacgttttatccgtggacccaaaactccggcgctggtcacagactgggaaggcagccttcccttggtgtttaatcattgcagggatgcctctctgattatacacccacgtttcaagggtgtcagaccacgcagggacaactgccttggtccttcacccttagcagcaagtcccgcttttctggggaaggggcaagtaccccaaccccttctctccgtgtctctaccccttctctgcttttccggggacagggcaagtaccccaaccccttctctccgtgtctctactccttctctgcttttctggggacagggcaagtaccccaaccccttctctccttgtctctaccccttctctgcttttctggggcaggggcaagtacccctcaaccccttctccttcacccttagcggtaagtcccgcttttctagggggcaggggcaagtaccccccaaccccttctccttcacccttagtggcaagtcctgctttcctggggcaggggcaagtaccccttaaccccttctccttcacccttagcagcaagtcccacttttctagggggcaagaaaccccaaaccccttccctccgtgtctttacgctctcttttctctgggtttgcttccttcactatgggcaaccttccatcctccattcctccttctcccttagcctgtgtgctcaagaacttaaaacctcttcaactcacacctgacctaaaacctaaatgcctcattttcttctgcaacaccgcttggccccaatacaaacttgacaatggctctaaatggccagaaaatggcactttcgatttctccatcctacaagacctaaataatttttgtcaaaaaatgggcaaatggtctgaggtgcctgatgtccaggcattcttttacacatccgtcccttcctagtctctgtgcccagtgcaactcgtcccaaatcttccttctttccctcccacctgtcccctcagtcccaaccccaggcgttgctgagtgtgtctaatcttccttttctacaaacccatctgacctctcccctcctctccacgccaagctaggtcccaattcttcctcaggctccactcctccaccctgtaatctttttatcacctcccctcctcacacctggtccggcttacagtttcgttccgtgactagccctcccccacctgcccagcaatttactcttaaaaaggtggctggagctaaagacatagtcaaggttaatgctcctttttctttatcccaaatcagaagcgtttaggctctttttcatcaaatataaaaacccagcccagttcatggctcgttcggcagcaaccctgagacgctttacagccctagaccctaaaaggtcaaaaggccgtcttattctcaatatacattttattacccaatctgctcccgatattaaataaaactccaaaaattaaattccggccctcaaactccacaacaggatttaattaacctcgccttcaaggtgtacaataataaaaaaaaaaaagttgcaattccttgcctccactgtgagacaaaccccagccacatctccagcaaacaagaacttccaaacacctgaaccgcagcagccaggcgttcctccagaacctcctcccacaggagcttgctacaagtgccagaaatctggccaccaagccaagaaatgcctgcagcccaggattcctcctaagccgtgtcccatctgtgcgggaccccattggaaatcagactgttcaactcacctggcagcgactcccagagaccctggaactctggcccaaggctctctgactgactccttcccagatcttctcggcttagcggctgaagactgacgctgcccaatcacctcggaagccctgtagaccatcacagacactgagctttaggtaactctcacagtggagggtaagtccgtccccttcttaatcaatatggaggctccccactccacattacctacttttcaagggcctgtttcccttgcctccataactgctgtgggtattgacggccaggcttctaaacctcttaaaacttcccaactctagtgccaacttagacaatactcttttacgcactcctttttagttatccccacctgcccagttcccttattaggccgagacactttaactaaattatctgcttccctgactactcctggactacagctgcatctcattgccgcccttattcctaatccaaagcctcctttgcgtcctcctcttgtatccccccaccttaacccacaagtataagatacctctactccctccttggcgaccgatcatgcaccccttaccatctcattaaaacctaatcacccttaccccgctcaacaccaatatcccatcccacagcatgctttaaaaggattaaagcctgttatcacttgcctgctacagcatgggctcctaaaacctataaactctccttaccattcccccattttacctgtcctaaaaccagacaagccttacaagttagttcagaatctgcgccttatcaaccaaatgttttgcctatccaccccgtggtgccaaacccgtatactcttctatcctcaatacctccctctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagcccccattacttcagtcaagcccaaatttcatcctcatctgttacctatctcagcataattctcataaaaacacaggtgctctccctgctgatcgtgtccgattaatctcccaaacctcaatcccttacaaaagaacaactcctttccttcctaggcatggttagtgtggtcagaattcttacacaagagccaggactgcaccctgtagcctttctgtccaaacaacttgaccttcctgttttagcctagccatcatgtctgtgtgcagccgctgccgctgctttaatactgttagaggccctcaaaatcacaaactatgctcaactcactctctacatttctcataacttccaaaatctattttcttcctcatacctgacgcatatactttctgctccccggctccttcagctgtactcacactttcttaagtcccacaattaccattgttcctggcctggacttcaatctggcctcccacattattcctgataccacacctgacctccatgactgtatctctctgatccacctgatattcaccccatatttccttctttcctgttcctcaccctgatcacgcttgatttattgatggaagttccaccaggcctaatcgccacacaccagcaaaggcaggttatgctatagtacaagccactagcccacctctcagaacctctcatttcctttccatcgtggaaatctatcctcaaggaaataacttctcagtgttccatctgctattctactactcctcagggattattcaggccccctcccttccctacacatcaggctggaggatttgccccacccaggactggcaaattacctttactcaacatgccctgattcaggaaactaaaatacctcttagtctaaatagacactttcactgaataaagtaaaggcctttcctacagggtctgagaaggccaccacagtcatttcttcccttctgtcagacacaattcctcagtttagccttcccacctctatacagtctgataacagaccagcctttattagtcaaatcagccaagcagtttttcaggctcttagtattcagtgaaacctttatatcccttacggtcctccttcttcaagaaaagtagaacggactaaaggtcttttaaaaacacacctcaccaagctcagccaccagcttaaaaaggactggacaatacttttaccactttcccttctcagaaatcaggcctgtcctcagaatgctacaaggtacatcccatttaagctcctgtatagacgctcctttttattaggccccagtctcattccagacaccagaccaacttagactgtgccccaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataatctttgctggcaggactatgctgaatctccttaggcactctctaatcagatgtcctaggtcctcccaattcttagacatttaatacccatttttctcctccttttattcggaccttgtatcttccatttagcttctcaaatcatccaaaaccgtatccaggccatcaccaatcattctatacgacaaatgtttcttctaacatccccatgatatcaccccttaccacaagacctcccttcagcttaatctctcccactctaggctcccacgccgcccctaatcccgcttgaagcagccctgagaaacatcgcccattatctctccataccaccccccaaaaattttcgctgccccaacacttcaacactattttgttttatttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacattccaacattgtgatttgttcctgccccaccctaactgataaatgtactttgtaatctcccccacccttaagaaggtcctttgtaattctccccacccttgagagtgtactttgtgagatccacacctgcccaccagagaacaaaccccctttgactgtaattttccattaccttccctaatcctataaaacggccccaccccatctccctttgctgactctcttttcggactcagcccgcctgcacccaggtgaaataaacagccttgttgctcacacaaagcctgtttggtggtctcttcacacggacgcgcgtgaaa

SEQ ID NO: 3 - DNA, 4729 bp, Homo sapiens
gtcaggcctctgagcccaagccaagccatcgcatcccctgtgacttgcacgtatacatccagatggtctgaagtaactgaagatccacaaaagaagtaaacatagccttaactgatgacattccaccattgtgatttgttcccgccccaccctaactaatcaatgtactttgtaatctcccccacccttaagaaggttctttgtaattctccccacccttgagaatgtactttgtgagatccacccctgcccacaaaacattgctcttaacttcaccgcctatctcaaaacctataagaactaataataatccaccactctttgctgactctctgtttggactcagcccacctgcacccaggtgaaataaacagccatgttgctcacacaaagcctgtttggtggtctcttcacacggacgcgcatgaaatttggtgtcgtgactcagattgggggacctcccttgggagatcaatcccctgtcctcctgctctttgctctgtgagaaagatccacctacgacctcaggaccgaccagcccaagaaacatctcaccaatttcaaatccagtaagcggcctctttttactctcttctccaacttgcctcactatccctcaacctctttctcctttcaatcttggcgctacacttcaatctctcccttctcttaatttcaattcctttcattttctggtagagacaaaagagacacgttttatccgtggacccaaaactccggcgccggtcacggactgggaaggcagccttcccttggtgtttaatcattgcagggatgcctctgtgattatacacccacgtttcaagggtgtcagaccacgcagggacgcctgccttggtccttcacccttagcggcaagtcctgcttttctggggaaggggcaagtaccccaaccccttctctccttgtctctaccccttctctgcctttcctggggcaggggcaagtacccctcaaccccttctccttcacccttagcggcaagtcccgctttcctaggggcaagaacctcccaatcgcttatttccgcaccccaacctcttatctctgtgccccaatcccttatttccgtgccccaaccctttctctgcttttctggagggcaagaactccccaccccttctccatgtctctactcttttctctgggcttgcctccttcactatgggtaggcttccaccttccattcctccttgttctcccttagcctgtgttctcaaaaacttaaaacctcttcaactcacacctgacctaaaacctaaatgccttattttcttctgcaatgccgcttgaccccaatacaaactcgacagtagttccaaatagctggaaaacggcgctttcaatttttccatcctacaagatctaaataattcttgtcgtaaaatgggcaaatggtctgaggtgcctgacgtccaggcattcttttacacatcagtcccttcctagtctctgtgccccgtgcaactcgtcccaaatcttccttctttccctccctcctgtcccctcagtcccaaccccaagcggcgctgagtctttctaatcttcctcttctacagacccatctgacctctcccctccgcgccagcccaagctaggtcccaattcttcctcagcctccgcgcctcccctcccttcatcccacacctggtccgacttatagtttcattctgtgactagccctcccccacctgcccagcagtttactcttaaaaaggtggctggagccaaaggcatagtcagggttaatgctcctttttcattatcccaaatcacatagcgtttaggctctttttcatcaaatataaaaacccagcccagttcatggctcgttcggcagcaaccctgagacgctttacagccctagaccctaaaaggtcaaaaggccatcttattctcaatatacattttattacccgatctgctcccgacattaaataaaactccaaaaattaaattccggccctcaaaccccacaacaggatttaattaacctcgccttcaaggtgtacaataatagaaaaaagttgcaattccttggctccactgtgagacaaaccccagccacatctccagcatacaagaacttccaaatgcctgaaccgcagcggccaggcgttcttctagaacctcctcccccaggagcttgctacaagtgccagaaatctgaccaccagggcaaggaatgcctgcagcccaggattcctcctaagccgtgtcccatctgtgcgggaccccactggaaattagactgttcaactcacctggcagccactccccgagcccctggaactctggcccgaggctctctgactgactccttctcggcttagcggctgaagactgatgctgcccgatcgcctcggaagccccgtaggccatcacggacgccgagctttgggtaactctcagagtggaaggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaacactcttttaagcactcttttttagttatctccacctgcccacttcccttattaggccgagatattttaaccaaattatctgcttccctgactattcctggactacagccgcatctcattgctgcccttcttcccaatccaaagcctcctttgcgtcctcctcttgtattcccccaccttaacccacaagtataagagacctctactccctccttggtgactgatcacgcaccccttaccatctcattaaaactgaatcacccttaccccgctcaacgccaatatcctatcccacagcatgctttaaaaggattaaagcctgttatcactcgcctgctacagcatgggcacctataaactctccttaccattcccccatttcacctgtcctaaaaccaggcaaggcttacaagttagttcagaatctgcaccttatcaaccaaattgttttgcctatccaccctgtggtgccaaacccatatactctcctatcctcaatacctccctctactacccattattctgttctggatctcaaacatgctttctttactattcctttgcacccttcatcccagcctctctttgccttcacttagactgaccctgacacccattaggctcagtaaattacctgggctgtactgccgcaaggcttcgcggacagcccccattacttcagtcaagcccaaatttcatcctcatctgttacctatctcggcataattctcatagaaacacatgtgctcttcctgctgatcatgtccgattaatctcccaaacctcaatcccttacaaaagaacaactcctttccttcctaggcatggttagtgcggtcagaattcttacacaagagccaggaccacaccgtgtagcctttctgtccaaacaacttgaccttactgttttagcctagccctcatgtctgcgtgcagcggctgccgctgctttaataccgttagaggccctaaaaatcacaaactatgctcaactcactctctacatttctcataacttccaaaatctattttcttcctcatacctgacacatatactttctgctccccggctccttcagctgtactcactctttaagtcccacaattaccattgttcctggcccggacttcaatctggcctcccacattattcctgataccacacctgacccccatgactgtatctctctgatccacctgatattcaccccatttccccatatttccttctttgctgttcctcaccctgatcacgcttgcctcgtgctatccccaaactgccattcttaactcttgaagtaaataatctttgctggcagggctatgctgaatctccttaggcactctctaatcagatgtcctgagtcgtcccaattcttagaccttttatacctgtttttctccttctcttattccatttagtttttcaattcatacaaaaccatatccaggccatcaccaataattctacacaacaaatgtttcttctaacaaccccacaatatcaccccttaccacaaaatcttccttcagcttaatctctcccactctaggttcccacgccacccctaatcccgctcgaagcagccctgagaaacatcgcccattctctctccacaccaacccccacaaattttcaccgccccaagacttcaacactattttgttttatttttcttattaatataagaaggcaggaatgtcaggcctctgagcccaagccaagccatcgcatcccctgtgacttgcacgtatacatccacgtggcctgaagtaactgaagatccacaaaagaagtaaacatagccttaactgatgacattccaccattgtgatttgttcccgccccaccctaactaatcaatgtactttgtaatctcccccacccttaagaaggttctttgtaattctccccacccttgagaatgtactttgtgagatccaccccgcccacaaaacattgctcttaacttcactgcctaacccaaaacctataagaactaataataatccaccactctttgctgactctctttttggactcagcccacctgcacccaggtgaaataaacagccatgttgctcacacaaagcctgtttggtggtctcttcacacagacgcgcatgaaa

SEQ ID NO: 4 - DNA, 4609 bp, Homo sapiens
gtcaggcctctgagcccaagccaacccatcgcatcccctgtgacttgcacgtatacgcccagatggcctgaagtaactgaagaatcacaaaagaagtgaaaaggccctgccccgccttaactgatgacattccaccattgtgatttgttcctgccccaccttaactgagtgattaaccctgcaaatttccttctcctggctcagaagctcccccactgagcaccctgtgacccccacccctgcccaccagagaacaaccccctttgactgtaattttccattaccttcccaaatcctataaaacggccccacccctatctccctttgctgactctctttttggactcagcccgcctgcacccaggtgaaataaacagccatgttgctcacacaaagcctgtttggtggtctcttcacacagatgcgcaagaaatttggtgccgtgactcggatcaggggacctcccctgggagatcaatcccccgtcctcctgctctttactccatgagaaagacccacctacgacctcaggtcctcagaccaaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacatgttttatccgtgtacccaaaactccggcgccagtcacggactgggaaggcagccttcccttggtgtttaatcattgcagggacgcctctctgattatacacccacgtttcaagggtgtcagaccacgcagggacacctgctttggtccttcacccttagcggcaagtcccgcttttctggggaaggagcaagtaccccaaccccttctctccttgtctctaccccttctctgcttttccagggacagggcaagtaccccaaccccttctctccttgtctctaccccttctctgcttttccggggagagggcaagtaccccaaccccttctctccttgtctctaccccttctctgcttttccagggacagggcaagtaccccaaccccttctctccttgtctctaccccttctctgcttttctgggagaggggaaagtacccctcaaccccttctccttcacccttagcggcaagtcccgctctcctagggggcaagaaccccccaatcgcttatttccatgccccaacctctgatctctgcgccccaatcacttatttccatgccccaacctcttatgtctgtgccccaatcccttttttccacaccccaacctcttatttctgtaccccaatcccttatttccatgccccaaccctttctctgcttttctggagggcaagaaccccccaccccttctccgtgtctctactcttttctctgggcttgcctcctttactatgggcaagcttccaccttccattcctccttcttctcccttagcctgtattcttaagaacttaaaacctcttcaattctcacctgacctaaaatctaagcgtctcattttcttctgcaatgccgcttgaccccaatacaaactcgacagtagttccaaatagccagaaaacggcactttcaatttttccatcctacaagatctaaataattcttgtcgtaaaatgggcaaatggtctgaggtgcctgacgtccaggcattcttttacacatcagtcccttcctagtctctgtggccagtgcaactcgtcccaaatcttccttctttccctcccgcctgtcccctcagtaccaaccccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctgctccggcttacagtttcgttccgtgactagccctccccctcctgcccagcaatttactcttaaaaaggtggctggagccaaaggcatagtcagggttaatgctcctttttctttatcccaaatcagatagtgtttaggctttttcatcaaatataaaaacccagcccagttcatggctcattcggcagcaaccctgagacgctttacagctctagaccctaaaaggtcaaaaggccgtcttatgctcaatatacattttattacccaatctgccccggacattaaataaaactccaaaaattaaatccggccctcaaaccccacaacaggacttaattgacctcaccttcaaggtgtagaataataaaaaaaaaaagttgcaattccttgcctccgctgtgagacaaaccccagccacatctccagcacacaagaacttccaaatgcctgaaccacagcagccaggcgttcctccagaacctcctcccacaggagcttgctacatgtgccggaaatctggccactaggccaaggaatgcctgcagccccggattcctcctaagccgtgtcccatctgtgcgggaccccactgaaaatcggactgttcaactcacctggcagccactctcagagaccctggaactctggcccaaggctctctgactccttcccagatcttcttggcttagcggctgaagactgacactgcccgatcgcctcggaagccccctagaccatcatggacgccgagcttcgggtaactctcacagtggaaggtaagcccgtccccttcttaatcaatacggaggctacccactccacattaccttcttttcaagggcctgtttcccttgcctccataactgttgtgggtattaacagccaggcttctaaacctcttaaaactccccaactctggtgccaacttagacaatactcttttaagcactcctttttcgttatccccacctgcccagttcccttattaggctgagacactttaactaagttatctgcttccctgactattcctggactacagccacatctcattgccgcccttctccccaacccaaagcctccttcgcgtcttcctctcatatccccccaccttaacccgcaagtatgggacatctctactccttccctggcaaccgatcacatgccccttaccatcccattaaaacctaatcacccttaccccgctcaacgccaatatcccatcccacagcacgctttaaaaagattaaaacctgttatcactcgcctgctacagcgtggccttttaaagcttataaactctccttaccattcccccattttacctgtcctaaaaccagacaagccttacaagttagttcagaatctgcgccttatcaaccaaattgttttgcctatccaccccgtggtgccaaacccatagactctcctatcctcaatacctccctctactacccattattctgttctggatctcaaacatgctttctttactattccttgcacccttcatcccagcctctctttgccttcacttagactgaccctgacacccattaggctcagcaaattacctgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgccccgccttaactgatgacattccactattgtgatttgttcctgccccaccttaactgagtgattaaccctgcgaatttccttctcctggctcagaagctcccccactgagcaccttgtgaccccccacccctgcccaccagagaacaaccccctttgactaattttccattaccttcccaaatcctataaaacggccccacccctatctcccttcgctgactctcttttcggactcagcccacctgcacccaggtgaaataaacagccatgttgctcacacggagcctgtttggtggtctcttcacacagacgcgcatgaaa

SEQ ID NO: 5 - DNA, 6026 bp, Homo sapiens
gtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagcagctcccccactgagcaccttgtgacccccgcccctgcccaccagagaacaaccccctttgactgtaattttccattaccttcccaaatcctataaaacggccccaccccatctcccttcgctgactctcttttcggactcagcccgcctgcccccaggtgaaataaacagccatgttgctcacacaaagcctgtttggtgtctcttcacatggactcgagtgaactttgatgccgtggctcggatcgggggacctcccttaggagatcaatcccccgtcctcctgctctttgctccatgagaaagatccacctacgaccttaggtcctcagaccaaccagcccaagaaacatctcaccaattttaaatccagtaagccgcctctttttactctcttctccaacctccctcactatccctcaacctctttctcctttcaatcttggcgccacacttcaatctctcccttctcttagtttcaattcctttcattttctggtagagacaaaggagacacgttttatctgtggacccaaaactccagcgctggtcacggactgggaaggcagccttcccttgctgtttaatcattgcagggacacctctctgattattcacccacgtttcaagggtgtcagaccatgcagggatgcctgccttggtccttcacccttagcggcaagtcccgcttttctggggaaggggaaagtaccccaaccccttctctctgtgtctctacccgttctctgcttttctggggaaggggcaagtaccccaaccccttctctctgtgtctctaccccttccctgcttttctggggaaggggcaagtaccccaaccccttctcttcttgtctctaccccttctctgattttctggggcaggggcaagaacccctcaaccccttctccttcacccttagtggcaagtcccacttttctgggggaggggaaagtacccctcaaccccttctccttcacccttagtggcaagtcccgcttttctagggggcaagaacccccaatcccttatttccacaccccgacctcttatttctgtgacccaatcccttatttccacaccccaacctcttatctctgtgccccaatcccttatttccatgccccaaccccccttcccacttttctagggggcaagaacccccaatcccttatttccacaccctgacctcttatctctgtgccccaatcccttatttctgtgccccaaccctttctctgcttttctggagggcaagaaacccccaccccttctccgtgtctctactcttttctctgggcttgcctccttcactatgggcaagcttccaccttccattcctccttcttctcccttagcctgtattcttaagaacttaaaacctcttcaactctcacctgacctaaaatctaagtgtctcattttcttctgcaatgcctcttgaccccaatacaaactctacagtagttccaaatagccggaaaacggcactttcaatttttccatcctacaagatctaaataattcttgtcataaaatgggcaaatggtctgaggtgcctgacatccaggcattcttttacacatcagtcccttcctagtctctgtgcccagtgcaactcattctgaatcttccttctttccctcccgcctgtcccctcagtcccaaccccaagcgtcactgagtctttctaatcttccttttctacagacccatctgacctctcccctccttgccaggccaagctaggtcccaattcttcctcagcctccgctcctccaccctgtaatctttttatcgcctcccctcctcacacctggtctggcttacagtttcgttctgtgactagccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatgtctcgttcggcagcaaccctgagatgctttacagccctagaccctaaaaggtcaaaaggccatcttattctcaatacacattttattacccaatctgctcccgacattaaataaaactccaaaaattagaatctggccctcaaaccccacaacaggacttaattaacctcaccttcaaggtgtacaataataaaaaaaaggaagttgcaattccttgcctccactgtgagacaaaccccagccacatctccagcacacaacaacttccaaatgcctgaaccgcagtggccagacattcctccagaacctcctcccccaggagcttgctgcaagtgccagaaatctgaccaccagggcaaggaatgcctgcagcccagggattcctcctaagccatgtcccatctgtgcgggaccccactggaaatcggactgttcaactcacctggcagccactcccagcgcccctggaactctggcccaaggctctctgactgactccttcttggcttagtggctgaagactgacgctgcctgatcgcctcagaagccctgtagaccaccatggacaccgagctttaggtaactctcacagtggagggtaagtctgtccccttcttaatcaatatggaggctacccactccacattaccttcttttcaagggcctgtttcccttgcctccataactgttgtgggtattgacagccaggcttctaaacctcttaaaactccccaactctggtgccaacttgaacaacactcttttatgcactcttttttagttatctccacctgcccagttcccttatcaggccgagatattttaaccaaattatctgcttccctgactattcctggactacagctgcatctcattgctgcccttcttcccaatccaaagcctcctttgcgtcctcctcttgtattcccccaccttaacccacaagtataagatacctctactccctccttggcgaccgatcatgcaccccttaccatctcattaaaacctaatcacgcttacccgactcaatgccaatatcccatcccacagcatgctttgaaaggattaaagcctgttatcactcacctgctacagcatggccttttaaagcctataaactctccttacaattcccccgttttacctgtcctaaaaccagacaaggcttacaacttagttcagaatctgtgccttatcaaccaaattgttttgcctatccaccccgtggtgccaaacccatatactctcctatcctcaatacctccctctactacccattattctgttctggatctcaaacatgctttctttactattcctttgcactcttcatctcagcctctctttgccttcacttagactgaccctgacacccattaggctcagcagcttacctgggctgtgctgccgcaaggttccagggacagccctcattacttcagccaagctctttctcatgatctactttctttccacccctccacttctcaccttattcaatatattgatgaccttcttctttgtagcccctcctttgaatcttctcaacaagacatacttctgctccttcagcatttattctccaaaggatatcgggtatccccctccaaagctcaaatttcttctccatccgttacctacctcggcataattcttcacaaaaacacaggtgctctccctgctgatggtgtctgattaatctcccaaacctcaatcccttacaaaacaacaactcctttccttcctaggcatggttagtgcggtcagaattcttacacaagagccaggaccccaccctgtagcctttctgtccaaacaacttgaccttactgttttagcctagccctcatgtctgcatgcagcagctgccgctgctttaataattttagaggccctaaaaatcacaaactatgttcaactcactctctacatttctcataacttccaaaatctattttcttcctcatacctgacgcatatactttctgctccccggctccttcagctgtactcattctttgttaagtcccacaattaccattgttcctggcccagacttcaatctggcctcccacattattcctgataccacacctgatccccatgactgcatctctctgatccacctgacattcaccccatttccccatattacaagccactagcccatctcttagaacctctcatttcctttccattgtagaaatctatcctcaaggaaataacttctcagtgttccatctgctattctatctgctattctgctactcctcaaggatcattcaggcccctcccttccctacacatcaagctcgaggatttgcccccgcccaggactggcaaattagctttactccacatgccccgagtcacaaaaactaaaatacctcttagtctaagtagacattttcactagataggtagaggcctttcctacagggtctgagaaggccaccgcagtcatttcttcccttctgtcagacataattcctcagtttagccttcccacctctatacagtctgataacagaccaggctttattagtcaaattagccaagcagtttttcagtttatatcccttatagtcctctgtcttcaagaaaagtagaacggactaaaggtcttttaaaaacacacctcaccaagctcagccaccaacttaaaaagaactggacaatacttttaccactttcccttctcagaagtcagacctgtcctcagaatgctacaaggtacagtccatttaagctcctttttattaggccccagtctcatcccagacaccagaccaacttagactgtgcccccaaaaaaacttgtcatccctactattttccgtctagtcatactcctattctccgttctcaactactcatacatgccctgctcttgtttacactgccagtttacactgtttctccaagccatcatggctgatatctcctcatgctatccccaaactgccactcttaactcttgaagtaaataaataatcttcgctggaaggactatgctgaacctccttaggcattctctaattagatgtcctagatcctcccaattcttagtccttttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctaatcccgcttgaagcagccctgagaaacatcgcccattctctctccataccaccccccaaaaattttcaccgccccaacacttcaacacaattttgttttatttttcttattaatataagaaggcaggaatgtcaggcctctgagcccaagccaagccatcgcatcccctgtgacttgcacgtatacgcccagatggcctgaagtaactgaagaatcacaaaagaactgaaaaggccctgccccgccttaactgatgacattccaccatggtgatttgttcttgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccgcctgcccccaggtgaaataaacagccatgttgctcacacaaagcctgtttggtgtctcttcacacggacgcgcatgaaa

SEQ ID NO: 6 - DNA, 2771 bp, Homo sapiens
tgggtcaggtacaaataagcccaccccactaggaactatgttaaaaaaaaattcaagaaagaatttaagggagattacagtgttactgtgacaccaggaaaacttagaactttgtgtgaaatagactggccagcattagaggtgggttggccatcagaaggaagcctggacaggtcccttgtttcaaaggtatgacacaaggtaacccgtaagccaaggcacccagaccagtttccatacatagaaagttacagctgcttttatacccccttgccccgccaacgtagttaagagaacagcagcataagcggctggcagaggcaaggaaagaccagtagagagaaaaaaaggccatctataccaattctaagttaatttagactaaacaaggtcttaatagcaaaggataattgaaatcccaaacttacaaggttttcaacaaaagtgaagtttgcttaaagttaacagtgtaacatgtattatggtaacttctaatcttgtggccttagacagtctagtccaaaggcataaagaaagtttgctttaaaaaaaaaaaaaaggaatggttatcttcaaaaaaaaaaaaagtggggggagacagaatttatgtaaaaagagtgttatatggtaaattcttgtcctgaaataaactaactggtgtttaaagaaaaaaaatgtttgtaataagtcagaaagttgagacacattgaagaattgtcggcaaaagtcgtgaaagaaaaaatgttataaaaaaatttatgcaaaaaatgttgtataatttaaaagtaataaggcctcctgagtactattaaaaaaacagtttatgtgcaaggtgtataagaaaagtaaaacatacctttggtaaaaagattataaaggggcataagaatgtggatttttacctacattaaaaggttaaaaacaattattgttttaaaagtttaagcaagttttaaaacgttaattataaagaaaattctgtgtgtaaacatattagctaaagttaaaaaggtatcatccagtttttctgtgaactggacattaaagtaaaaaatgccacaggtttttcttaaagcatcaacctgctctttaacaaaaattataaaaggttaaaaagagtctataaaatcttaccttatggtcaaacatgaaaaattggataaatatgtctacaaggttttattaaaattcagtttaaaattaataacacactaatataaaggtaaaatttagcttatctggtataaaaatcatacaagaaacattattaaatataaaatggtgtttagctttctttggtctaaaaactaataaaaattggtgctaaaggaaacattcattttactagaggatcataaaagttaaagacttaaaacaaactttggcaattaagacagcacgccaagatgcaagtgcctggctgaaatggatcaaatattccatctgcactttaaacaaatgcaattgttatgcttgtgcacatggcaggccagaggccctgattgtcccccttccactaaggtggtcctccagttgaccaggcatgggctgcagggtagctattttccaggtttctacagcttggagtaataagtcatgccaagctctctctgctatatcccaaagtccctgcgggtcagcccctgagggccgtccagcttccgtctcccaacactaagttcacttcatgtctctcatggcagggaggagacttagcattccttggagacctgaagggatgcagtgagcttaagaattttcaagagcttatcagtcagtcagcccttgttcatccccgagcggatgtgtgatggtattgtcgtggacctttattgggcactctgccgaataactagagtggcacttgtgctttagcctatttggctatccctttcaccctggcatttcatcaaccagaggaaggaaaaaaaaaataataagacatcgtaaagcgagagaagccccttatgggtctttcaactctcacatctatttagatgcaatcgaagccccgcaaggaacaccagatcaatttaaagtccgaaatcaaatagctacaggatttaagtcaatattttggtagatgacagtcaataaaaatgtagattagataaactgcatctattacacccaacagcaatgagcttttcatgagttgaaaaaaagaaaaaacccatgtcggccccagccctggggctacctgacctgacaaaaccttttacactctatgtgtcagaaagagaaaaagtggcagttggagttttaacccagactgtagggccctggccaaggccagtggcctatctctcaaaacaactagatgaggtttccaaacgctggcccccatgtccaaagtccctggtagcaatagccctgttagcacaagaagcagataagctaactcttagacaaaacctaaacataaagtccccctatgctgtggtgattttaataaataccaaaggacaccattagctaatgaatgctagactagctagataccaaagcttgctctgtgaacatccccgcataaccattgaagtttgcaacacctaaaccccgccaccttcctcccggtgtcagagagcccagttaaacataactgtgtagaggtattggactcagtttattctagtgggcctaaccaccgagaccatccttaaacatcagtagactgggagctgtacatggatgggagcagcttcaccaacccctgcaaagtgactctgaagaagacgacaagccctgctccagtcacacccggaagctga

SEQ ID NO: 7 - DNA, 5535 bp, Homo sapiens
aactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatatactttgtgagatccacccctgcccaccagaggacaaccccctttgactgtaattttccattaccttcccaaatcctataaaacggccccacccgtatctcccttcgctgactctcttattggactcagcccacctgcacccaggtgaaataaacagccatgttgctcacacaaagcctgtttggtggtctcttcacacagacgcgcatgaaatttggtgccgtgactcggatcgggggacctcccttgggagatcaatcccctgtcctgctgctctttgctccgtgagaaagatccacctatgacctcaggtcctcagaccgaccagcccaagaaacatcgcaccaatttcaaatccggtaagcggcctctttttactctcttctccaacttccctcactatccctcaacctctttctcctttcaatcttggcgctacgcttcaatctctcccttctcttaatttcaattcctttcattttctggtagacacaaaagagacgttttatccgtggacccaaaactccggcgccggtcacggactgggaaggcagccttcccttggtgtttaatcaatgcagggacgcctctctgattatacacccacgtttcaagggtgtcagaccacgcagggacacctgccttggtccttcacccttagcggcaagtcctgcttttctggggaaggggcaagtagcccaaccccttctctccttgtctctaccccttctctgctttcctggggcaggggcaagtacccctcaaccccttctccttcacccttagcggcaagtcccgctttcctggggcaggggcaagtacccctcaaccccttctccttcacccttagcggcaagtcctgcttttctagggggcaagaacccccaaaccacttccctccgtgtctctacgctctctgttctctgggcttgcctccttcactatgggcaagcttccaccttccattcctccttcttctcccttagcctgtgttcttaagaacttaaaacctcttcaactctcacctgacctaaaatctaagcatcttattttcttctgcaatgccgcttgaccccaatacaaactcgacagtagttccaaatagccagaaaacagcactttcaatttttctgtcctacaagatctaaataattcctgtcgtaaaatgggcaaattgtctgaggtgcctgacgtccaggcattcttttacacatcagtccattcctagtctctgtgcccaatgcaactcgtcccaaatctcccgcctgtcccctcagtcccaacgccaagcatcgctgagtctttctaatcttccttttctacagacccatctgacctctcccctcctagccaggccaagctaggtcccaattcttcctcagcctccactcctccaccctataatctttttatcgcttcccctcctcacacctggtcgggcttacagtttcattccgtgactagccctcccccacctgcccagcaatttattcttaaaaaggtggctggagctaaaggcatagtcaaggttaatgctcctttttatttatcccaaatcagatagcgtttaggctttttcatcaaatataaaaaccctgcccagttcatggctcgttcggcagcaaccctgagactctttacagccctagaccctgaaaggtcaaaaggccatcttattctcaatatacattgtattacccaatctgctcccgacattaaataaaactccaaaaattaaattctggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccacagcagccaggcttcctccagaacctcctcccccaggagcttgctacaagtgccagaaatctgaccaccaggccaaggaatgcctgcagcccaggattcctcctaagccatgtcccatctgtgcgggaccccactggaaactggactgttcaactcacctggcagccactcccagagcccctggaactctggcccaaggctctctgactgactccttctcggcttagcggctgaagactgatgctgcccgatcgcctcggaagccccgtagaccatcacggacaccgagctttgggtaactctcacagtggaaggtaagtccgtccccttcttaatcaatatggaggctacccactccacattaccttcttttcaagggcccgtttccgttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcccaatccaaagcctcctttgtgtcctcctcttatatccccctaccttaacccacaagtataagatacctctactccctccttggcgaccgatcatgcaccccttaccatctcattaaaacctaatcacccttaccccgctcaatgtcaagatcccatcccacagcacgctttaaaaggattaaagcctgttatcactcgcctgctacagcatgaccttttaaagcctataaactctccttaccattcccctgttttacctgtcctaaaaccagacaaggcttacaagttagttcagaatctgcgccttatcaaccaaattgttttgcctatccaactcgtggtgccaaatccatatactctcctatcctcaatacctctctctactacccattattctgttctagatctcaaacatgctttctttactattcctttgcacgcttcatcccagcctctctttgctttcacttagactgaccctgacacccatcaagctcagcaaattaccttggctgtactgccgcaaggcttcacagacagcccccattacttcagtcaagcccaaatttcaccctcatctgttacctatctcggccaaattctcataaaaacacacgtgctttccctgctgatcgtgtctgattaatctcccaaacctcaatccctttcaaaacaacaactcctttccttcctaggcatggttagtgcggtcagaattcttacacaagagccaggaccgcaccctgtagcctttctgtccaaacaacttgaccttactgttttagcctagccctcatgtctgcgtgcagcggctgccgctgctttaatacttttagaggccctcaaaatcacaaactatgctcaactcactctctacatttctcataacttccaaaatctattttcttcctcatacctgatgcatatactttctgcttcccggctccttcagctgtactcactctttaagtcccacaattaccattgtttctggcccggacttcaatccggcctcccacattattcctgataccacacctgacacccatgactgtatctctctgatccacctgatattcaccccatttccccatatttccctctttcctgttcctcaccctgatcacgcttgatttattgatggcagttccaccaggcctaatcgccgcataccagcaaaggcaggttatgctatagtacaagccactagcccacctctcagaacctctcatttcctttccatcgtggaaacctgtcctcaaggaaataacttctcagtgttccatctgctattctactactcctcagggattattcaggccccctcccttccctacacatcaagttcgaggatttgcccctacccaggactggcaaattagctttactcaacgtgcctgagtcaggaaactaaaatacctcttagtccaaatagacactttcactgaataagtaaaggtctttcctacagggtctgagaaggccaccgcagtcatttctttccttctgtcagacataattcctcagtttagccttcccacctctatacagtctgataacggaccagcctttattagtcaaatcagccaagcagtttttcaggctcttagtaggtttcagtgaaaactttatatcccttacggtcctccgtcttcaagaaaagtagaacggactaaagatcttttaaaaacacagctcaccaagctcagccaccaacttaaaaggactgacaatacttttaccacttttgcttctcagaattcaggcctgtcctcaatgctacaaggtacagcccatttaagctcctgtatagacgctcctttttattaggccccagtctcatttgacaccagaccaacttagactgtgccccaaaaaaacttgtcatccctactatcttttgtccagtcatactcctattcaccgttctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagtttctcaattcatccaaaaccgtatccaggccatcaccaatcattctatacaacaaatgtttcttcttacatccccacaatatcaccctttaccacaagacctcccttcagcttaatctctcccactctaggttcccacgccgcccctaatcctgcttgaagcagccctaagaaacattgcccattctctctccataccacccccacaaaaattttcgccgccccaacacttcaacactattttgttttgtcttattaatataagaaggcaggaatgtcaggcctctgagcccaggccaggccatcgcatcccctgtgacttgcacgtatacatccagatggcctaaagtaactgaagatccacaaaagaagtaaaaacagccttaactgatgacattccaccgtgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaacggccccacccatatctcccttcgctgactctcttttcggactcagcccacctgcacccaggtgaaataaacagccatgttgctcacacaaagcctgtttggtggtctcttcacacggacatgtatgaaa

SEQ ID NO: 8 - DNA, 5575 bp, Homo sapiens
gtcagacctctgagcccaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttttaattctccccacccttgagaatgtactttgtgagctccacccactgtctgcaaaacattgctcttaacttcagcgcctatcccaaaacctataagaactgatgataatccaccaccctttgctgactctcttttcggactcagcccgcctgcacccaggtgaaataaacagccatgttactcacacaaagcctgtttggtggtctcttcacacggacgtgcatgaaatttggtgccgtgactcggatcgggggacctcccttgggagatcaatcccccgtcctcctgctctttgctctgtgagaaagatccacctacgacctcaggtcctcagactgaccagcccaagaaacatctcaccaatttgaaatccggtaagcagcctctttttactctcttctgcaacctccctcactatccctcaacctctttctcctttcaatcttggcaccacatttcaatctctcccttctcttaatttcaattcctttcattttctggtagagacaaaggggacacgttttatccgtggacccaaaactccggcgccggtcacggactgggaaggcagccttcccttggtgtttaatcattgcaaggatgcctctctgattattcacccacgtttcaagggtgtcagaccacacagggacgcctgccttggtccttcacccttagcggcaagtcccgcttttctggggaaggggcaagtaccccaaccccttctctccttgtctctatcccttctctgcttttctggggaaggggcaagtaccccaaccccttctctccgtgtctctaccccttctctccgtgtctctaccccttctctgcctttctgggggaggggcaagtacccctcaaccccttcttcacccttagcggcaagtcccgcttttctagggggcaagaacccccaattccttatttccacaccccgacctcttatctctgtgccccaattccttatttctgcaccctgacctcttatctctgtgccccaatcccttatttctgcaccccgacctctcaactctgtgccccaatcccttatttctgcaccccaacctcttatctctgtgccccaatcccttatttccgtgccctgaccccccttcccgcttttctggagggtaagaacccccgaaacccttccctccatgtctctacattctcttttctctaggtttgcctccttcactatgggcaaccttccaccctccattcctccttcttctcccttagcctgtgttctcaagaacttaaaacctcttcaactcacacctgacctaaaacctaaatgccttattttcttctgcaatgccgcttgaccccaatacaaactcgacagtagctccaaatagccagaaaacggcactttgaatttttccatcctgcaagatctaaataattcttgtcgtaaaataggcaaacggtctgagttgcctgacgtccaggcattcttttacacatcagtcccttcctagtctttgtccccaatgcaactcgtcccaaatcttccttctttcccttccgcctgtcccctcagtcccaaccccaagcgtcgctgagtctttctaatcttccttttctacagacccatctgacctttcccctcctccccaggctgctcctcgccaggccgagctaggtcccaattcttcctcagcctctgctcctccaccctataatccttttatcacctcgcctcctcacacctggtccagcttacagtttcgttccgtgactagccctcccccacctgcccagcaatttactcttaaaaaggtggctgaagctaaaggcatagtcaaggttaatgctcctttttctttatcccaaatcagaagcatttaggctctttttcatcaaatataaaaacccagcccagttcatggctcgtttggcagcaaccctgagacgctttacagccctagaccctaaaaggtcaaaaggccgtcttattctcaatatacattttactacccaatctgctcccgacattaaataaaactccaaaaattggaatctggccctcaaaccccacaacaggacttaattaacctcaccttcaaggtgtacaataacagaaaaaagttgcaattccttgcctccactgtgagacaaaccccagccacatctccagcacacaagaacgtccaaacgcctgaaccacagcagccaggggttcctccagaacctcctcccccaggagcttgctacacgtgccggaaatctggccactgggccaaggaatgcccgcagcccgggattcctcctaagctgcgtcccatctgtgtgggaccccactgaaaatccgactgttcaactcacctggcagccactcccagagcccctggaactctggcccaaggctctctgactgactccttcccagatcttctcggcttagcagctgaagactgacactgcccgattgcctcggaagccccctaaaccatcacggatgccgagcttcaggtaactctcacggtagaaggtagtaagcgcgtccccttcttaatcaatacggaggctacccactccacattaccttcttttcaaaggcctgtttcccttgcctccataactgttgtaagtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagccacatctcattgccgcccttcttcccaatccaaagcctcctttgcgtcctcctcttgtatccccctaccttaacccacaagtataagatacctctactccctccttggtgaccgatcatgtaccccttaccgtctcattaaaacctaatcacccttaccccactcaatgtcaagatcccatcccacagcacgctttaaaaggattaaagcctgttatcactcgcctgctacagcatggccttttaaagcctatgaactcttcttaccattcccccattttacctgtcctaaaaccagacaagccttacaagttagttcagaatctgcgccttatcaaccaaattgttctgcctatccacccggtggtgccaaacccatactcgatacctccctctactacccattattctgttctagatctcaaacatgctttctttactattcctttgcacccttcatcccagcctctctttgctttcacttagactgaccctgacacccattaggctcagcaaattacctcggctgtactgccgcaaggcttcacagacagcccccattacttcagtcaagcccaaatttcatcctcatctgttacctatctcagcataattctcataaaaatacacgtgctctccctgctgatcgtgtctgattaatctcccaaacctcagtcccttacaaaataacaactcctttccttcctaggcatggttagtgcagtcagaattcctacacaagagccaggacaggactgcaccctgtagcctttctgtccaaacaacttgaccttactgttttagcctagccctcatgtctgtgtgcagcggctgccgctgctttaatactgttagaggccctaaaaatcgcaaactatgctcaactcactctctacatttctcataacttccaaaatctattttcttcctcatacctgacgcatatactttctgctccccagctccttcagctgtactcactctttgttaagtcccacaattaccattgttcctggcccggacttcaatctggcctcccacattattcctgataccacacctgacccccatgactgtatctctctgatccacctgatattcaccccatttccccatatttccttctttcctattcctcaccctgatcacgcttgatttattgatggcagttccaccaggcctaatcgccacacaccagcaaaggcaggctatgctatagtacaagtcactagcccgcctctcagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctcaatacagtctaataacagaccatcctttactagtcaaatcagccaagcagcttttcaggctcttagtattcagtgaaacctttatatcccttacggtcctccatcttcaagaaaaggagaacggactaaaggtcttttaaaaacacacctcaccaagctcagccaccaacttaaaaaggactggacaatactttcaccactttcgtttctcagaattcaggcctgtcctcagaatgctacaaggtacagcccatttaagctcctgtatagacgctcctttttattaggccccagtcccattcgacaccagaccaacttagactgtgccccaaaaaaacttgtcatccctactatcttttgtctagtcatactcctattcaccattctcaactactcatacatgccctgctcttgtttacactgctggtttatactgtttctccaagccatcacagctgatatctcctggtgctatccccaaactgccactctaaactcttgaagtaaataaataatctttgccggcaggactatgctgaatctccttaggcactctctaatcagatgtcctaggtcctcccaattcttagaccttttatacctgtttttctccttctcttattccatttagtttctcaattcatccaaaaccatatgcagtccatcaccaatcattctatacgacaaatgtttcttctaacatccccacaatatcaccccttaccacaagacctcccttcagcttaatctctcccactctaggttcccacgccgcccctaatcccgcttgaagcagccctgagaaacatcgcccattctctctccattccaccccccaaaaattttcgccgccccaacacttcaacactattttgttttatttttcttattataagaaggcaggaatgtcaggcctctgagcccaagccaagccatcgcatcccctgtgacttgcacgtatacatccagatggcctgaagtaactgaagatccacaaaagaaataaaaatagccttaactgatgacattccatcat

SEQ ID NO: 9 - DNA, 6045 bp, Homo sapiens
gtcaggcctctgagcccaggctaagccatcatatcccctgtgaccggcacctatacatccagatggcctgaagcaactgaagatccacaaaagaagtgaaaatagccttaactgatgacattccaccattgtgatttgtttctgtcccaacctaactgatcaatgtacttggtaatctcccccacccttaagaaggttctttgtaattctccccacccttgagaatgtactttgtgagatccaccccctgcctgcaaaacattgctcctaacaccaccgcctatcccaaaacctataagaaccatgataatccaccaccctttgctgacccttttcggactcagcccgcctgcacccaggtgaaataaacagccttgttgctgacacaaagcctgtttggtggtctcttcacacggacgcatgaaacaatatgtttactgcagcactacttatagttttttattatttctttatttattttttgagacggagtctctctctgttgctcaggctggagtgcagtggtgcgatcttggctcactgcaacctccacctcctggattcaagcgattttcctgcctcagcctcccgctgagtggtaggcgcccgccaccactcctagcaaaattttatttatttatttttattttttagtagagacagggtttcgtcatgttggccaggctggtcttgaactcctgacctcaggtgatccacctgtctcggcctcccaaagtgctgggattacaggtgtgagccaccgtgcctggacacttttttatttttaacatcaaacatgttttaaagtattttaaaggacctaatagaagaatagcctatgtatttacccatacataggtaaatgttcttcttcctttattcctcctgtttcaagtttcctttttatataattccccttccgtctcaaaaaaattcctctaaaatctttgaaaggtagggtaccagtgacaaattatcttagtttctcttcctctgagaatgtctttatttcacctcattcctggagaatatttttactagatctgaaattccatattgaaccattctttccttcccacaatttaacaatagtcttccattctcttctgtgtgccatggtttctgatgtgaaatccgcagttataggccaggtgcggtggctcactcctgtaatcccagcactttgggaggctgaggcgggtggatcacctgaggtcagtgtcaggcctctgagcccaggccaggccatcgcatcccctgtgacttgcaggtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtacttggtgagatccacccctgcccaccagagaacaaccccctttgactgtaattttccattaccttcccaaatcctataaaacggccccacccctatctcccttcgctgactctcttttcggactcagcccgcctgcgcccaggtgaaataaacagccatgttgctcacacaaagcctgtttggtggtctcttcacacggatgcgcatgaaatttggtgccgtgactcagatcaggggacctcccttgggagatcaatcccctgtcctcctgctctttgctccgtgagaaagatccacctatgacctcaggttctcaaaccgaccagcccaagaaacatctcaccaatttcaaatctggtaagcagccttttactctcttctccaatctccctcactatccctcagcctctttctcctttcaatcttggtgctacacttcaatctctcccttctcttaatttcaattcctttcattttctggtagagacaaaagagacacgttttatccgtggacccaaaactccggcgccggtcacggactgggaaggcagccttcccttggtgtttaatcattgcagggacacctctctgattatacactcacgtttcaagggtgtcagaccacgcagggacgcctgccttggtccttcacccttagcggcaagtcccgcttttctggggaaggggcaagtaccccaaccccttctctccttgtctctaccccttctctgcttttctggggaaggggcaagtaccccaaccccttctctccttgtctctaccccttctctgctttcctggggcaggggcaagtacccctcaaccccttctccttcgcccttagcggcaagtcccgctttcctagggggcaagaaacccccaatcgcttatttctgcaccccaacctcttatctctgtgccccaatcccttatttccgcaccctgacctcttatctctgtgccccaatcccttatttccgtgccccaaccccttctctgcttttctggagggcaagaaccccccccctccttctccgtgtctctactcttttctctgggcttgcctccttcactatgggtaagcttccaccttccattcctccttcttctcctttagcctgtgttctcaaaaacttaaaacctcttccactcacacctgacctaaaacctaaatgccttattttcttctgcaatgccgcttgactccaatacaagctcgacagtagttccaaatagctggaaaacggcactttcaatttttccatcctacaagatctaaataattctcgtcgtaaaatgggcaaacggtctgaggtgcctgacgtccaggcattcttttacacatcagtcccttcctagtctctgtgcccaatgcaactcgtcccaaatcttccttctttccctcccgcctgtcccctcagtcccaaccccaagcgtcgctgagtctttctaatgttccttttctacagacccatctgacctctcccttcctccccaggctgctcctcaccaggccgagctaggtcccaattcttcctcagcctccgctcctgcaccctataatcttttcatcgcctcccctcctcacacctgctctggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatggctcgctcggcagcaaccctgagacactttacagccctagaccctaaaaggtcaaaaggccgtcttattctcaatatacattttattacccaatctgttcccgacattaaataaaactccaaaaattaaattccagccctcaaaccccacaacacgatttaattaacctcgccttcaaggtgtaccataatagaaaaaagttgcaattccttgcctccacggtgagacaaaccccagccacatctccagcacacaagaacttccaaacgcctgaaccgcagcggccaggcgttcccccagaacctcctcccccaggagcttgctacaagtgccagaaatctgaccaccaggccaaggaatgcccgcagcctgggattcctcctaagccgcatcccatctgtgtgggaccccactgaaaatcggactgttcaactcacctggcagccactcccagagcccctggaactccggcccaaggctctctgactgactccttcccagatcttctcggcttagcggctgaagactgacactgcccgatcgcctcggaagccccctagaccatcacggacaccgagctttgggtaactctcacagtggaaggtaagtccgtccccttcttaatcaatatggagtctacccactccacattaccttcttttcaaggcctgtttccctgcctccataactgttgtgggtattgacggccaagcttcaaaacccctgaaaactcccccactcttgtgccaacttggacaacactcttttatgcactcttttttagttatccccacctgcccagttcccttatcaggccgagatattttaaccaaattgtatgcttccctgactattcctggattacagccgcatctcattgccgcccttctccccaacccaaagcctccttcgcatcttcctctcatatcccccaaccttaacccacaagtatgggacatctctactccttccctggcaactgatcacatgcccattaccatcccattaaaacctaatcaccctcaccccgctcaacgcccatatcccatcccacagcatgctttaaaaggattaaagcctgttaccactcgcctgctacagcatgggcttctaaaacctataaactctccttacaattcccccattttacctgtccaaaaactggataagtcttacagattagttcaggatctgcgtcctatcaaccaaattgttttgccatccaccctgtggtgcccaacccgtacactcttttgtcctcaatccgttcctccacaattcactattctgttctccaccttaaagatgcttttttcactattcccctgcacccctcgtcccagcctctctttgctttcacttagactgaccctgacacccattaggctcagcaaattaccaaggctgtactgctgcaaagcttcacagacagcccccattacttcaatcaagcccaaatttcttcctcatctgttacttatctcggcataattctcacaaaaacacacgtgctttccctgccaatcgtgtccgactgatctctcaaaccccagcaccttctacaaaacaacaactcctttccttcctaggcatggttagcgtggtcagaattcttacacaagagccaggaccacactctgtagcctttctgtccaaacaacttgaccttactgttttagcctagccctcatgtctgcgtgcagcggctgctgctgctttaatacttttagaggccctcaaaatcacaaactttatcagtcctccaggcccaagttgactcgttagctgcagttgtcctccaaaaccgccgaggccttgactgacttactgctgagaaaggaggactctgcatattcttaaatgaggagtgttgtttttacctaaatcaatctggcctggtgtatgacaacataaaaaaactcaaggatagagcccaaaaacttgccaaccaagcaagtaattatgctgaacccccttgggcactctctaattggatgtcctgggtcctcccaattcttagtcctttaatacccatttttctcctccttttatttggaccttgtatcttccgtttagcttctcaattcatccaaaaccgtatccaggccatcaccaatcattctatacgacaaacgtttcttctaacatccccacaatgtcaccccttaccacaagacctcccttcagcttaatctctcccactctaggttcccacgccgcccctaatcccgctcgaagcagccctgagaaacatcgcccattctctctccataccaccccccaaaaattttcgccgctccaacacttcaacactattttgttttatttgtcttattaatataagaaggcaggaatgtcaggcctctgagcccaggccaggccatcgcatcccctgtgacttgcaggtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggtactttgtagtctcccccacccttaagaaggttctttgtaattctccccacccttgagaatgtacttggtgagatccacccctgcccaccagagaacaaccccctttgactgtaattttccattaccttcccaaatcctataaaatggccccacccctatctcccttcgctgactctcttttcggactcagcccacctgcacccaggtgaaataaacagctttattgctcacacaaagcctgtttggtggtctcttcacacggacgtgtatgaaa

SEQ ID NO: 10 - DNA, 4776 bp, Homo sapiens
gtcaggcctctgagcccaggccaggccatcgcaccccctgtgacttgcacgtatacatccagacggcctgaagtaactgaagatccacaaaagaagtaaaaacagccttaactgatgacattccaccattgtgatttgttcctgccccaccctaactgatcaatgtactttgtaatatcccccacccttaaggtactttgtagtctcccccacccttaagaaggttctttgtaattctccccacccttgagaatgtactttgtgagatccacccctgcccaccagagaacaaccccctttgactgtaattttccattaccttcccaaatcctataaaatggccccacccctatctcccttcgctgactgtcttttcggactcagcctgcctgcacccaggtgaaataaacagccatgttgctcacacaaagcctgtttggtggtctcttcacagggacacgcatgaaatttggtgccgtgactcggatcgggggacctcccttgggagatcaatcccccgtcctcctgctctttgctccatgagaaagatccacctacgacctcaggtcctcagaccgaccagcccaagaaacatctcaccaatttcaaatccggtaagcggcctctactcttctccaacctccctcactatccctcaacctctttctcctttcaatcttggagccacacttcaatctctcccttctcttaatttcaattcctttcattttctggtagagacaaaagagacatgttttatccgtgaacccaaaactctggcgccggtcacggactgggaaggcagccttcccttggtgtttaatcattgcagggatgcctctctgattatacactcacgtttcaagggtgtcagaccacgcagggacgcctgccttggtccttcacccttagcggcaagtcccactttcctggggcaggggcaagtacccctcaaccccttccccttcaccctcagcggcaagtcctgctttcctggggcaggggcaagtacccctcaaccccttccccttcaccctcagcggcaagtcctgctttcctggggcaggggcaagtaccccttccccttcaccctcagcggcaagtcctgctttcctggggcaggggcaagtacccctcaaccccttctccttcatccttagcagcaagtcccgctttcctagggggcaagaaccccccaatcacttatttccacaccccaacctcttatctctgtgccccaatcccttatttccgcaccctgacctcttatttccatgccccaaccccttctctgcttttctggagggcaagaaccccccaccccttctctgtgttgctactcttttctctgggcttgcctccttcactatgggtaagcttccaccttccattcctccttcttctcccttagcctgtgttctcaaaaacttaaaacctcttcaactcacacctgacctaaaacctaaatgccttactttcttctgcaatgccgcttgactccaatacaagctcgacagtagttccaaatagccggaaaacggcactttcaatttttccatcctacaagatctaaataattcttgtcgtaaaatgggcaaatggtctgaggtacctgaagtccaggcattcctttacacatcagtcccttcctagtctctgtgcccagtgcaactcgtcccaaatctttcttctttccctcccgcctgtcccctcagtcccaaccccaagtgtcgctgagtctttctgatcttccttttctacagacccatctgacctctcccctcctcgccagcccaagctaggtcccaattcttcctcagcctctgctcctgcaccctgtaatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaccctgagatgcttcacagccctagaccctaaaaggtcaaaaggcaatattattctcaatatacattttattacccaatctgctcccgacattaaatctccaaaaattaaattccggccctcaaaccccacaacagaatttaattaacttcaccttcaaggtgtacaataatagaaaaagttgcaattccttgcctccactgtgagacaaaccccagccacatctccagcacacaagaacttccaaacgcctgaaccacagcggccaggcgttcctccagaacctccttccccaggagcttgctacaagtgccagaaatctgaccaccaggccaaggaatgcatgcagcccaggattcctcctaagccgtgtcccatctgtgcgggaccccactggaaattggactgttcaactcacctggcagccactcccagagtccctggaactctggcccaaggctctctgactgactccttctcggcttagcggctgaagactgatgctgcccgatcgcctcggaagccccgtagaccatcacggacgccgagcttccggtaactctcacagtggaaggtaagcccgtccccttcttaatcaatacggaggctacccgctccacattaccttcttttcaagggcctgtttcccttgcctccataactgtgggtattgacagccaggcttctaaacctcttaaaactcccccactctggtgccaacttggacaacactcctttatgcactcttttttagttattcccacctgcccagttcccttattaggccgagatattttaaccaaattatctgcttccctgactattcctggactacagccgcatctcattgccgaccttctccccaactcaaagcctccttcgcgtcttcctcttatatccccccaccttaacccacaagtatgggacatctctactccttccatcacccttaccccgctcaacgccaatatcccatcccacagcatgctttaaaaggattaaagcctgttatcactcgcctgctacagcatgggcttctaaaacctataaactcttacaattcccccattttacctgtccaaaaaccggataagtcttacagattagttcaggatctgcgtcttatcaaccaaattgttttgcctatccaccctgtggtgcccaacccgtacactcttttgtcctcaatacgttcctccacaactcactattctgttctccatcttaaagatgcttttttcactattcccctgcacccctcgtcccagcctctctttgctttcacttagactgaccctgacaccccattaggctcagcaaattacctgggctgtactgctgcaaagcttcacagacagcccccattacttcagtcaagcccagatttcttcctcatctgttacctatctcggcgtaattctcgtaaaagcacacgtgctttccctgccaatcgtgtccgactgatctctcaaaccccagcaccttctacaaaacaacaactcttttccttcctaggcatggttagcgtggtcggaattcttacacaagagccaggaccacaccctgtagcctttctgtccaaacaacttgaccttactgttttagcctagccctcatgtctgcgtgcagcagctgctgctgctttaatacttttagaggccctcaaaatcacaaactttatcagtcctccaggcccaagttgactctttagctgcagttgtcctccaaaaccgccgaggccttgacttacttactgctgaaaaaggaggactctgcatattcttaaatgaggagtgttgtttttacctaaatcagtctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcagaccttgtatcttccatttagcttctcagttcatccaaaactgtatccaggccatcaccaatcattctatatgacaaatgtttcttctaacatccccacaatatcatcccttaccacaagacttcccttcagcttaatctctcccactttatgttcccacgccgccccaatcccacttgaagcagccctgagaaacatcgcccattctctctccataccaccccccaaaaattttcgccgctccaacacttcaacactattttgttttatttgtcttattaatataagaaggcaggaatgtcaggcctctgagcccaggccaggccatcgcatcccctgtgacttgcacgtatacatccagatggcctgaagtaactgaagatccataaaagaagtaaaaacagccttaactgatgacattccaccattgtgatttgttcctgccccaccctaactgatcaatgtactttgtaatatcccccacccttaaggtactttgtagtctcccccacccttaagaaggttctttgtaattctccccacccttgagaatgtactttgtgagatccacccctgcccaccagagaacaaccccctttgactgtaattttccattaccttcccaaatcctataaaatggccccacccctatctcccttcgctgactgtcttttcggactcagcctgcctgcacccaggtgaaataaacagccatgttgctcacacaaagcctgtttggtggtctcttcacacggacgcacatgaaa

SEQ ID NO: 11 - DNA, 935 bp, Homo sapiens
gtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaa

SEQ ID NO: 12 - DNA, 3184 bp, Homo sapiens
gtcaggcctctgagcccaggccaggccatcgcatcccctgtgacttgcacgcatacatccagatggcctgaagtaactgaagatccacaaaagaagtaaaaacagccttaactgatgacattccaccattgtgatttgttcctgccccaccctagctgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggccccacccctatctcccttccctgactctcttttcggacgcagcccgcctgcgcccaggtgaaatacacagccatgttgctcacacaaagcctgtttggtgggctcttcacacggacacgtatgcaatttggtgccgtgactcggatcgggggacctcccttgggagatcaatcccctgtcctcctgctctttgctccgtgggaaagatccacctatgacctcaggtcctcagaccgaccagcccaagaaacatctcaccaatttcaaatccggtaagcggcctctttttactctcttctccaacctccctcactatacccttagcggcaagtcccgctttcctggggcaggggcaggtacccctcaaccccttctccttcaccctcagcggcaagtcccgctttcctggggcaggggcaggtgcccctcgaccccttctccttcaccctcagcggcaagtcccgctttcctggggcaggggcaggtgcccctcaaccccttctccttcaccctcagcggcaagtcccgctttcctggggcaggggcaggtgcccctcgaccccttctccttcaccctcagcggcaagtcccgctttcctggggcaggggcaggtacccctcgaccctttctccttcaccctcagcggcaagtcccgctttcctggggcaggacttgccgctttcctggggtagggacaagtacccctgaaccccttctccacattacctgcttttcaagggcctgtttcccttgcctccataactgttgtgggtattgacagccaggcttctaaacctcttaaaactcccccactctggtgccaacttggacgacactcttttatgcactcttttttagttatccccacctgcccagttcccttattaggccgagatattttaaccaaattatctgcttccctgactattcctggactacagctgcaactcattgctgcccttctcgctaacccaaagcctccttcgcgtctttctttcatatccccccaccttaacccacaagtatgggacatctctactccttccctggcaactgatcacatgcccattaccatcccgttaaaacctaatcacccttaccccactcaacgccagtatcccatcccacagcatgctttaaaaggattaaagcctgttatcactcgcctgctacagcatgggcttctaaaacctataaactctccttaccattcccccattttacctgtcctaaaaccagacagggcttacaggttagttcagaatctgtgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccattaggctcagcaaattacctaggctgtactgccgcaaggcttcacagacagcccccattacttcaatcaagcccaaatttcttcctcatctgttacctatctcggcataattctcataaaaacacacgtgctctccctgccaatcgtgtccgactgatctctcaaaccccggcacctttctacaaaacaataactcctttccttcctaggcatggttagcgtggtcgtaattcttacacaagagccaggaccacaccctgtagcctttctgtccaaacaacttgaccttactgttttaacctagccctcatgtctgcgtgcagcggctgccgctgctttaatacttttagaggccctcaaaatcacaaactttatcagtcctccaggcccaagttgactcttcagctgcagttgtcctccaaaaccgccaaggccttgactgacttactgctgaaaaaggaggactctgcatattcttaaatgaggagtgttgtttttacctaaatgcatctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcggaccttgtatcttccgtttagcttctcaattcatccaaaaccgtatccaggccatcaccaatcattctatacgacaaatgtttcttctaacatccccacaatatcaccccttaccacaagacctcccttcagcttaatctctcccactctaggttcccacgccgcccctaatcccgctcgaagcagccctgagaaacatcacccgttctctctccataccaccccccaaaaatttccgccgctccaacacttcaacgctattttgttttatttgtcttattaatataagaaggcaggaatgtcaggcctctgagcccaggccaggccatcacatcccgtgacttgcacgcatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccagcagagaacaaccccctttgactgtaattttccattaccttcccaaatcctataaaacggcccaacccctatctcccttccctgactctcttttcggacgcagcccgcctgcgcccaggtgaaataaacagccatgttgctcacacaaagcctgtttggtgggctcttcacacggacgcgcatgaaa

SEQ ID NO: 13 - DNA, 5641 bp, Homo sapiens
tcaggcctctgagcccaagccaagccatcacatgccctgtgacttacatgtatatgcccagatggcctgaagtaactgaagaatcacaaacaaagtgaatatgccctgccccaccttaactgatgacattccaccacaaaagaagtgtaaatggccagtccttgccttaagtgaggacattaccttgtgaaagtccttttcctagctcaccctggctcaaaaagcacccccactgagcaccttgagacccccactcctgcccaccagagaacaaaccccctttgactgtaattttcctttacctacccaaatcctataaaacggccccacccttatctcccttcgctgactctcttttcggactcagcccacctgcacccaggtgaaataaacagctttactgctcacacaaagcctgtttggtggtctcttcacacggacgcgcatgaaatttggtgccatgactcggatcaggggacctcccttgggagatcaatcccccgtcctcttgttctttgctccatgagaaagatccacctatgacctcaggtcctcagaccgaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcaattcctttggtagagacaaaggagacgcattttatccgtggacccaaaactccggcgccggtcacggactgggaaggcagccttcccttggtgtttaatctttgcagggacgcctgcctcggtccttcacccttagcggcaagtcctgctttcctggggcaggggcaagtacccctcaaccccttcttcaccctcagcggcaagtcctgctttcctggggcaggggcaagtacccctcaaccccttctccttcaccctcagcggcaagtcccgctttcctagggggcaagaaccccccaatcgcttatttccacaccccaacctcttatctctgcgccccaatcccttatttccgtgccccaaccccttctctgcttttctggagggcaagaaccccccacccctactccatgtctctactcttttgtctgggcttgcctccttcactatgggcaagcttccaccttccattcctccttcttctcccttagcctgtgttctcaaaaacttaaaacctcttcaactcacacctgacctaaaacctaaatgccttattttcttctgcaatgccacttgaccccaatacaaactcgacagtagttccaaatagccagaaaatggcactttcaatttttccatcctgcaagatctaaataattcttgtcgtaaaatgggcaaatgttctgaggtgcctgacgtccaggcattcttttacacatctgtcccttcctagtctctgtgcccagtgcaactcgtcccaaatcttccttctttccctcccgcctgtcccctcagtcccaaccccaagcgtcgctgagtctttctaatcttccttttctacagacccatctgacctctcctctcctcgccagctcaagctaagtcccaattcttcctcagcctccgctcctgcaccctgtaatctttttatcgcctcccctcctcacacctggtctggcttacagtttcattccgtgactagccctcccccacctgcccagcaatttacccttaaaaaggtggctggagccaaaggcatagtcaagtttaacgctcctttttctttatcccaaatcagatagcgtttaggctctttttcatcaaatataaaaacccagcccagttcatggctagtttggcagcaaccctgagaggctttacagccctaaaccctaaaaggtcaaaaggccgtcttattctcaatatacattttattacccaatctgctcccgacattaaataaaactccaaaaattaaattccggccctcaaaccccacacaggatttaatgaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctccaggagcttgctacaagtgccagaaatctgaccaccaggccaaggaatgcccgcagcccaggattcctcctaagccatgtcccatctgtgcaggaccccactggaaatcggactgttcaactcacctggcagccactcccagcgcccctggaactctggcccaaggttctctgactgactccttctcggcttagcggctgaagactgatgctgcccgatcacctcagaagccccctagaccatcacggacgccgagcttcaagtaactctcacagtggagggaagtccgtccccttctttatcaatacggaggctacccactccacattaccttcttttcaagggcctgtttccctcgcctccataactgttgtgggtattgatgaccaggcttctaaacctcttaaaactccccaactctggtgccaacatagacaatactcttttaagcactcctttttagttatccccacctgcccagttcccttattaggccaaaacactttaactaaattatctgcttccatgactattcctagactacagctatatctcattgctgcccttcttcccaatccaaagcctcctttgcgtcctcctcttgtatcccccccaccttaacccacaagtataagatacctctactccctccttggtgagactgatcacgcaccccttaccatctcattaaaacctaatcacccttaccccgctcaacgccaatatcccatcccgcagcacgctttaaaaagattaaagcttgttatcactcgcctgctacagcatggccttttaaagcctataaattctccttacaattcccccattttacctgtcctaaaaccagacaagccttacaagttagttcaggatctgcaccttatcaaccaaattgttttgcctatccaccccatggtgccaaacccatatactctccaatcctcaatacctgcctctactacccattattctgttctggatctcaaacatgctttctttactattgctttgcacccttcatcccagcctctctttgctttcacttggactgaccctgacacccatcaagctcagcaaattacctaggctgtactgccgcagagcttcacagacagcccccattacttcagtcaagcccaaatttcttcctcatctgttacctatctcggcataattctcataaaagcacacgtgctctccctgccaatcgtgttcgactgatctctcaaacccaagcatcttctacaaaacaacaactcctttccttcctaggcatggttagcgcggtcagaattcttacacaagagccaggaccacaccctgtagcctttctgtccgaacaacttgaccttactgttttagcctagccctcatgtctgcgtgcagcggctgctgctgctttaatacttttagaggccctcaaaaatcacaaactatgctcaactcactctctacagttctcataacttccaaaatctattttcttcctcatacctgacgcaaatactttctgcttcccggctccttcagctgtactcactctttgttgagtctcccacaattaccgttgttcctggcccagacttcaatctggcctcccacattattcctgataccacacctgacccccatgactatctctctgatccacctgacattcaccccatttccccaaatttccttctttcctgttcctcacgctgatcacgcttgatttattgatggcggttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctgcacatcaagctcgaggatttgccccacccaggactggcaaattagctttactcaacatgccctgagtcagataactaaaatatctcttagtctaggtagatactttcactggataggtagaggcctttcctacagggtctgggaaggccaccgcagtcatttcttcccttctgtcagacataattcctcagtttagccttcccacctcaatacagtctgacaacagatgagcctttattagtcaaatcagccaagcaggttttcaggctcttagtattcagtgaaacctttacatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagatgctcctttttattaggccccagcctcattccagacaccagaccaacttagactgtgccccaaaaaacttgtcatccctactatcttctgtctagtcatactcctgttcaccgttctcaactactcatacatgccctgttcttgtttacactgccggtttacactgtttttccaagccatcacagctgatatctcctggtgctatccccaaactgccactcttaactcttgaagtaaataaataatctctgctggcaggactatgctgaatctccttaggcactctctaatcagatatcctgagtcatcccaattcttagaccttttatatctgttttactccttctcttattccatttagtttctcaattcatccaaaaccatatccaggccatcaccagtcattctatatgacaaatgtttcttctaacatccccacaatctcaccccttaccacaagacctcccttcagcttaatctctcccactctaggttcccacgcctcccctaatcccgcttgaagcagccctgagaaacatcacccattctctctccataccaccccccaaaaatttccgccgctccaacacttcaacactattgtgttttatttttcttattaatataagaagtcaggaatatcaggcctctgagcccaagccaagccatcgcatcccctgtgacttgcacgtatatgcccagatggcctgaagtaactgaagaatcacaaaagaagtgaatatgccctgccccaccttaactgatgacattccaccacaaaagaagtgtaaatgcccgggtcttgccttaagtgatgaccttaccttgtgaaagtccttttcctagctcatcctggctcaaaaatcacccccactgagcaccttgagacccccactcctgcccgccagagaacaaacccccttggactgtaattttcctttacctacccaaatcctataaaagggctccacccttatctcccttcactgactctcttttcggactcagcccacctgcacccaggtgaaataaacagctttactgctcacacaaagcctgtttggtggtctcttcacacggacgcgcatgaaa

SEQ ID NO: 14 - DNA, 5964 bp, Homo sapiens
gtcacgcctctgagcccaagccaagccatcgcatcccctgtgacttgcacgtatacccagatgacctgaagtaactgaagaatcataaaagaagtgaatatgccctgccccaccttaactgatgacattccaccacaaaagaagtgtaaatggctggtccttgccttaagtgatgacattaccttgtgaaagtccttttcctagctcatcctgactcaaaaagcacctccactgggcaccttgcgacccccactcctgcccgccagagaacaaaccccctttgactgtaattttcctttacctacccaaatcctataaaacggccccacccccatctcccttcactgactctatttttggactcagcctgcctgcgcccaggtgaaataaacagccatattgctcacacaaagcctgtttggtggtctcttcacacggacacgcatgaaatttggtgccgtgactcggatcgggggacctcccttgggagatcaatcccctgtcctcctgctctttgatccatgagaaagatccacctatgacctcaggtcctcagaccgaccagcccaagaaacatctcaccaatttcaaatccggtaagcagcctcttcttactctcttctccaacttccctcactatccctcaacctctttctcctttcaatcttggtgccacacttcaatctctcccttctcttaatttcaattcctttcattttctggtagagacaaaggagacatgttttatccgtggacccaaaactctggcaccggtcacggactgggaaggcagccttcccttgttgtttaatcattgcagggacgcctctctgattattaacccacgtttcaagggtgtcagaccatgcagggatgcctgccttggtccttcacccttagcagcaattcccgcttttctggggaaggggcaagtaccccaaccccttctctccttgtctctaccccttctctgcttttccagggacagggcaagtaccccaaccccttctctccttgtctctaccccttctcagcttttcttggagaggggcaagtacccctcaaccccttctccttcacccttagcgacaagtcccgcttttctgggggaggggcaagtaccactcaaccccttctccttcactcttagtggcaagtcccgcttttctagaggaggggcaagtaccccaacctcatatctctgtgccccaatcccttatttccatgccccaacctcatatctctgcaccccaatcccttatttccatgccccaacctcatatctctgcaccccaatcccttatttccacgccccgacctcttatttctgcgccccatcccttatttccgtgccctgacctcttatctctgagccccaaccccttttcccacttttctggaaggtaagaacccctgaaccccttccttccatttctctactctctcttttctctaggcttgcttccttcactatgggaaacttccaccctccattcctccttctactcccttggcctgtgttctcaaaaacttaaaacctcaactcacacctgacctaaaacctaaatgccttattttcttctgcaatgtctcttgaccccaatacaaactcgacagtagttccaaatagccagaaaatggcactttgaatttttccatcctgcaagatctaaataattcttgttgtaaaataggcaaatggtctgaggtgcctgatgtccaggtattcttttacacatcagtcccttcctagtctgtgcccattgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctgtaatcctttcatcacctcccctcctcacacctggtccggcttacagtttcgttcagtgactagccctccccctcctgcccagcaatttactcttaaaacggtggctggagctaaaggcatagtcaaggttaatgctcctttttctttatcccaaatcagaagcgtttaggatctttttcatcaaatataaaaacccagcccagttcatgactcctttggcagcaaccctgagacactttacagccctagaccctaaaaggtcaaaaggccgtcttattctcaatatacattttattacccaatctgctcccgacactaaataaaactccaaaaattaaattccagccctcaaaccccacaacaggatttaatgaacctcgccttcaaggtgtacaataatagaaaaaagttgcaattccttgcctccactgtgagacaaaccccagccacatctccagcacccaagaacttccaaacgcctgaaccacagcggccaggcgttcctccagaacctcctcccacaggagcttgctacatgtgccggaaatctggccactgggccaaggaatgcccgcagcccgggattcctcctaacctgtgtcccatctgtgtgggaccccactgaaaattggactgttcaactcacctggcagccactcccagaggccctggaactctggcccaaggctctctgactccttcgcagatcttctcggcttagcggctgaagactgacgctgccggatcgcctcggaagccccctagaccatcacggacgccgagcttccggtaactctcacagtggaaggtaagcccgtccccttcttaatcaatacggaggccacccacgccacattaccttcttttcaagggcctgtttcccttgcctccataactgttgtggatattgacggccaggcttctaaacctcttaaaactccccaactctggtgccaacttagacaatactcttttaagcactcctttttagttatccccacctgcccagctcccttattaggctgagacactttaactaaattatctgcttccctgactattcctggactacagctatgtctcattgccgcccttcttcccaatccaaagcctcctttgtgtcctcctcttgtatccccccaccttaacccacaagtataagatatctctactccctccttggcgaccggtcatgcaccccttaccatctcattaaaacctaatcacccttaccccactcaacgccaatatcccatcccacagcacgctttaaaaagattaaagcctgttatcactcgcctgctaaagcatggccttttaaaacctataaactctccttacaattcccccattttacctgtcctaaaaccagacaagccttacaatttagttcaggatctgcgccttatcaaccaaattgttttgcctatccaccccatggcgccaaacccatatactctcctatcctcaatacctgcctctacaacccattattctgttctagatctcaaacatgctttctttactattcctttgcacccttcatcccagcctctcttcactttcatttggactgaccctgacacccatcaagctcagcaaattacctaggctgtactgctgcaaaggttcacagacagcccccattacttcaatcaagcccaaatttcttcctcatctgttacctatctctgcataattctcataaaaacacacgtgctctccctgccaatcgtgtccgactgatctctcaaacccaagcaccttctacaaaacgacaactcctttccttcctaggcatggttagcgcggtcagaattcttacacaagagccaggacaacaccctgtaggctttctgtccaaacaacttgaccttactgttttagcctagccctcatgtctgcatgcagcggctgccactgctttagtacttttagaggccctcaaaatcacaaactgtgctcaactcattctctacagttctcctaacttccaaaatctattttcttcctcatacctgatggatatactttctgcttcctggctccttcagctatactcacactttgttgagcctcccacaattaccattgttcctggcccagacttcaatccggcctcccacattattcctgataccacacctgacccccatgactatctctctgatccacctgacattcaccccgtttccccaaatttccttctttcctattcctcaccctgatcatgcttgatttattgatggcggttccaccaggcctaatcgccacacaccagcaaaggcaggttttgctatagtacaagccactagcccacctcttagaacctctcatttcttttccatcgtggaaatctatcctcaaggaaataacttctcagtgttccatctgctattctactactcctcagggattattcaggcctcctcccttccccacacatcaagctcgaggaattgccccacccaggactggcaaattagctttactccacatgccctgagtcagaaaactaacatatctcttggtctaggtagacactttcactggataggtacaagcctttcctacagggtctgagaaggccaccgcagtcatttcttccattctgtcagacataattcctcagtttagccttcccacctcaatacagtctgataacagatgagccttcattagtcaaatgagccaagcagtttttcaggctcttagtattcagtgaaacctttatatcccttacggtcctccatcttcaagaaaagtagaaaggactaatggtctattaaaaacacacctcaccaagctcagccaccaacttaaaaaggactggacaatacttttaccactttcccttctcagaattcaggcctgtccttagaatgctacagggtacagcccatttaagctcttgtatagacgctcctttttattaggccccagtctcattccagacaccagaccaacttggactgtgccccaaaaaacttgtcatccctactatcttctgtctagtcatactcctattcaccgttctcaactactcatacatgccctgctcttgtttacactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttagacattttatacctgtttttctccttctgttattccatttagtttctcaattcatccaaaaccgtatctaggccatcaccaatcattctatatgacaaatgtttcttctaacatccccacaatatcaccccttaccacaagacctcccttcagcttaatctctcccactctaggttcccaagccacccctaatcccgcttgaaacagccctcagaaacatcgcccattctctctccataccaccccccaaaaattttcgctgccccaacacttcaacattattttgttttatttttcttattaatatcagaaggcaggaatgtcaggcctctgagcccaagccaagccatcacatcccctgtgacttgcacgtatatgcccagatggcctgaagtaactgaagaatcacaaaagaagtgaatatgccctgccccaccttaactgatgacattccaccgcaaaagaagtgcaaatggccagtccttgccttaagtgatgacattaccttgtgaaagtccttttcctggctcatcctggctcaaaaagcacccccactgaacaccttgcgacccccactcctgcccgccagagaacaaaccccctttgactgtaattttcctttacctacccaaatcctataaaacggccccacccctatctcccttcactgactctcttttcggactcagcctgcctgcacccaggtgaaataaacagccatgttgctcacacaaagcctgtttggtggtctcttcacacggacgcgcatgaaa

SEQ ID NO: 15 - DNA, 477 bp, Homo sapiens
agaccactactactcctgctgtcctcctccccctaccttgcctagttcacaagacaggaggagagaaaaagcaaaaagttggaaaaaaacaaaagtaagataaatagccagacaacctgggcgccaccacctggccctaggagttaaaaaaagtaataataataacatcaacccctgacctaaactgcttgtgttatctgtaaattccagacactgtatgaaaaaagcattgtgaaactttttttctgttagctgttgcatgtagcccccagtcacgtttcccacgcttgcttgatgtatcgcgaccattttgcgtggaccccttaaagttgtaagcctttaaaaaggccaaggatttcttttttggggagctgagctcttaagacgcgagtctgctgacgctcctggctgaataaaaacctcttccttctttaatctggtgtctgaggagttttgtctgcggctcatcctgctaca

SEQ ID NO: 16 - DNA, 6304 bp, Homo sapiens
gtcaggcctctgagcccaagctaagccatcatatcccctgtgacctgcacgtacacatctagatggccggttcctgccttaactgatgacattccgccacaaaaaaagtgaaaatggcctgttcctgccttaactgatgacattatcttgtgaaattccttctcctggctcatcctggcttaaaagctctcctactgagcaccttgtgaccccccactcctgcctgccagagaacaacccctctttgacggtgattttcctttacctacgcaaatcttataaaacggccctacccctatctcccttcgctgactctcttttcggactcagcccacctgcacccaggtgattaaagagctttattgctcacacaaagcctgtttggtggtctcttcatatggacgagagtgaaatctggtgccgtgacttggatcaggggacctcccttgggagatcaatcccctgtcctgctttttgttccatgagaaagattcacctacgacctctggtcctcagaccaaccagcccaaggaacatctcaccaattttaaatctggtaagcggcctctttttactctcttctccaacctctctcactatccctcaacctctttctcctttcaatcttggtgccacacttcaatctctcccttctcttaatttcagttccttttcttttctagtagagacaaaggagacgcgttttatccattgacccaaaactccggtgctggtcactgacttgggaagacagtcttcccttggtgtttaatcacgtggggatggctgcctgattattcacccatgtttcagaggtgtctgaccatgcaaggacgcctgccttggtccttcacccttagcggcaagtaccgcttttctggagggcaagaaacccccaaccccttctctccgtgtctctaccccttctccgcttttctgggaggcaagaatcccccgacccttctctccatgtctaccccttctccacttttctgcggggcaagaaacccccagccccttctccttcacccttagcagcaagtaccacttttctagagggcaagaatcccccaacccttctctccgtgtctctaccccttctccacttttctggggcgcaagaaccccccaccccttctctctgtgtctctactctctcttttctctgggcttgcctccttcactatgggcaagctcccgccctccattcccttcttctcccttagcctgtgttcttaaaaacctaaaacctcttcaactcacacctgacctaaaacctaaatgccttttcttctgcaatcctgcttgaccccaatacaaacttgacagtagttccaaatagccaaaaaatggcagtttcaatttttccatcctacaagacctaaataattcttgtcacaaaataggcaaacggtctgaggtgcctgacgtccaggcattcttttacacatcagtccctccctagtctctgttcccagtgcaactcatcccaagtcttccttctttccctcccgcctgtcccctcagtcccaaccccacgcgtcgctgagtcttcctaatctttcttttctacagacccatctgacttctcccctcctcaccaggccgagctaggtcacaattcttcctcagcctccactcctccaccctataatcattttatcacctcccctcctcacacccggtccggcttagtttcgttccgcgactagccctcccccacctgcccagcaatttcctcttaaaaaggtggctggagctaaaggcatagtcaaggttaatgctcctttttctttatcccaaatcagatagtgtttaggcttttttcatcaaataaaaaacgcagcccagttcatggctcatttggcagcaaccctgggatgctttacagccctagaccctaaaaggtcaaaaggccgtcttacactcaatatacattttattacccaatccgctccggacattaaataaaacttcaaaaattaaattccagccctcaaaccccacaacaggacttaattaacctcgccttcaaggtgtacaataataaagtagaggcagccaagtagcaatgtatttctgagttgcaattccttgcctccactgtgagacaaaccccagccatatctccagcacacaagaactccaaacgcctgaactgcagctgctggggttactctagaacctcctcccccaggagcttgctacaagtgccagaaatctggccactgggccaaggaatgcctacagcccaggattcctcctaagctgtgtcccatctgtgcaggaccccactgaaaattggactgttcaactgacctggcagccactttcagagcccctggaactctggcccaaggctctctgactgactccttcccagatcttctcagcttagcggctgaagactgacactgcccaattgcctcggaagcctacgggaccatcacagatgctctgggtaactctcacagtggagagtaagtctgtccccctcttaatcaatacggagcctacccattccacattaccttcttttcaagggcctgtttcccttgcccccataaccgttggaggtattgacggccaggcttctaaacctcttaaaactccccaactctggtgctaatttagacagtactcttttaagcactcctttttagttatccccacccgcccagttcacttattaggccgagacacttaaactaaattatctgcttccctgcctattcctgggctacagccacacctcaatgccgccttttcccccagttcagagcctccttcacatcctccctttgtatctccccatcttaacccacaagtataggacacctctactccctccttagcaactgatcatgcaccccttaccatcccattaaaacctaatcactcttaccccgctcaatgccaatatcccatcccatggcatgctttaaaaggattaaagtctgttatcactcgcctgctacagcatggccttttaaagcctataaactctccttacaattccccaattttacctgtcctaaaaccagacaaggtttacaggttagttcaggatctgcgccttatcaaccaaattgttttgcctatccaccccatggtgccaaacccatacactctcctatcctcaatacctccctccacaacccattattctgttctggatctcaaacatgctttctttactattcctttgcacccttcatcccagcctctcttcgctttcacttggactgaccctgacacccatcaggttcagcaaattacctgggctatactgccgcaaagcttcacagacagcccccattacttcagtcaagcccaaatttcttcctcatctgttacctatctcggcataattctcataaagacacgtgctctccctgctgatcgtgtccggctaatctcccaaaccccaatcccttctacaaaacaacaactcctttccttcctaggcatggttagtgtggtcagaattcttacacaagagccgggaccacaccctgtagcctttctgtccaacttgaccttactgttttagcctagccctcatgtctgcatgcagcggctgccgctgctttaatacttttagaggccctaaaaatcacaaactatgctcaattcactctctacagttctcataacttccaaaatctattttctttctcccacctgatgcatatactttctgctccctggctccttcagctgtactcacttcttgttgagtctcccacaattaccattgttcctggcccagacttcaatccagcctcccacagtattccagataccacacctgacccccatgactgtatctctctgatccacctgacattcaccccatttccccatatttcctttcctgttcctcaccctgaacacatttggtctattgatggcagtttcaccaggcctaatcgccacacaccaccaaaggcaggctatgctatagtacaagccaccagcccacctcttagaacctctcatttcctttccattgtggaaatctatcctcaaggaaataacttctcagtgttccatctgctattctactactcctcagggattattcagtccccctcccttccctacacatcaagctcgagaatttgcccccgcccaggactggcaactcttaactccctcttagagtggatagatgatctctgctggcaggggaccctccaatacttccaccctgatgaagttctattgtttagttttatactcactcttattatcattcccattcttatgccaccctctacctctccccagctatctccaccatactatcaactttactcattctctcctagccgtttctaatccctccttagcgaacaaccgctggctttgcatttccctttcttccagtgcctacacagctgtccccgccttacatgcagactaggcaacatctcctgtctccctatacctccgaacttcctttaacagccctcacctttaccctcctgaagaactcatttactttctagacaggtccagcaagacctccccagacatttgacatcagcaagctgccaccctcctccgcacttacttaaaacacctttctccttatatcaactctactccccacatatttggacccctcacaacacaaactactattcctgtggctgctcctttatgtatctctcgtcaaagacccattggaattcccctgggtaacctttcaccttctcgatgttcctttactcttcatctccaaagccctcttcttgtttacttatacccagccccgaaaataacagtgaaaggttggtcgtagacactcgacgttttctcacacaccatgaaaatcgaacctccccctctacacagttacctcatcagttcccgttacaacctctgacggctgccgccctagctggatccctaggagtctaggtacaagacacctttttcagcactccttctcatctttttagtttgcatctccagttttgcctcgcacaaggtctcttcttcctctgtggatcctctacctacatgtgtctacctgctaattgggcaggtacatgcacactagttttccttactcccaaaattcaatttgcaaataggaccgaagagctccctgttcccctctgacaccgacacgacaaaaaagagttattccactaattcccgtgcttgtcagtttaagactttctgcctccactattgctctcagtattggaatagcaggcatttcaacctctgtcacgaccttccatagcctctctaatgacttctctgctagcatcacagacatcccacaaactttatcagtcctccaggcccaagttgactctttagctgcagttgtcctccaaaaccgccgaggccttgacttactcactgctgaaaaaggaggactccgtatattcttaaatgaagagtgttgtttttacctaaatcaatctggcctagtgtatgacaacataaaaaactcaaggatagagcccaaaaacttgccaaccaagcaagtaattacgctgcaccccctggggcactctctaattagatgtcctaggtcctcccaattcttagtcctttaatacctgtttttctccttctcttattctgtttagtttttcaattcatacaaaaccatatccaggccatcaccaataattctacacgacaaaatgtttcttctaacaaccccacaatatcaccccttaccataaaatcttccttcagcttaatctctcccactctaggttcccatgctgcccctaatcccgcttgaagcagccctgagaaacatcgcccattatctctccataccacccccaaaaatttcgctgtcccaaaactttaccactatttcattttatttttcttattaatataagaagacaggaatgtcaggcctctgagcccaagctaagccatcatatcccctgtgaggtgcacgtacacatccagatggctggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccactagagaacaacccccctttgactgtaattttcctttacctacccaaatcttataaaacggccctaccccatctcccttcgctgactctcttttcggactcagcctacctgcatccaggtgattaaaaagctttattgctcacacaaagcctgtttggtggtctcttcacacggacgagagtgaaa

SEQ ID NO: 17 - DNA, 5710 bp, Homo sapiens
gtcaggcctctgagcccaagccaagccatcgcatcccctgtgacttgcacgtatgcccccagatggcctgaagtaactgaagaatcacaaaagaagtaaaaaggccctgccccaccttaactgatgacattccaccattgtgatttgttcctgccccaccttaactgagtgattaaccctgtgaatttccttctcctggctcagaagctcccccactgagcaccttgtgaccccccgcccctgcccaccagagaacaaccccctttgactgtaattttccattaccttcccaaatcctataaaacggccccacccctatctcccttcgctgactctctttttggactcagcccacctgcacccaggtgaaacaaccagccatgttgctcacacaaagcctgtttggtggtctcttcacacagacgcgcatgaaatttggtggatcaggggacctcccttgggagatcaatcccctgtcctcctgctctttgctccatgagaaagctccacctaccacctcaggtcctcagactgaccagcccaagaaacatctcaccaatttcaaatccggtaagtggcctctttttactctcttctccaacctccctcactatccctcaacctctttctcctttcaatcttggtgccacacttcaatctctcccttctcttaatttcaattcctttcattttctggtagagacaaagaagacacgttttatccgtggacccaaaactccagcactggtcatggactgggaagacagacttcccttggtgtttaatcattgcagagacacctctctgattattcacccacatttcaaaggtgtcagaccacatagggaggcctgccttggtcctccacccttagcggcaagtcccgcttttctgggggaggggcaagtatcccaaccccttctctccatgtctctaccccttctctgcttttctgggggaggggcaagtacccctcaaccccttctccttcacccttagcggcaagtcctgcttttctgggggaggggcaagtaccccaaccccttcttcagtgtctctaccccttctctgcttttctgggggaggggcaagtacccctcaaccccttctccttcacctttagtggcaagtcccgcttttctagggggcaagaacccccaatcccttatttctgtaccccaacctcttatctctgtgccccaatcccttatttccatgccccacccccccttcccacttttctggagggtaagaacccccaaaacccttccctccgtgtctctacaccctcttttctctgggtttgcctccttcactatgggcaaccttccatcctccattcctccttcttctcccttagcctgtgttctcaagaacttaaaacctcttcaactcacacctgacctaaaacctaaatgccttattttcttctgcaatgacgcttaaccccaatacaaactcgacatagttccaaatagccagaaaacggcactttcaatttttccatcctacaagatctaaataattcttgtcgtaaaatgggcaaatggcctgaggtgcctgacgtccaggcattcttttacacatcagtcccttcctagtctctgtgcccagtgcaactcatcccaaatcttccttctttccctcccgcctgtcccctcagtcccaaccccaagcatcgctgagtctttctaatcttccttttctacagacccatctgacctctcccctcctcgccaggccgagctaggtcccaattcttcctcagcctccgctcctctaccctataatctttttatcgcctcccctcctcacacctggtccggcttacagtttcgttccgtgactagccctcccccacctgcccagcaatttattcttaaaaaggtggctggagccaaaggcatagtcaaggttaatgctcctttttctttatcccaaatcagaagcgtttaggctgtttttcatcaaatataaaaatccagcccagttcacggctcgtttggcagcaaccctgagacgctttacagccctagaccctaaaaggtcaaaaggccatcttattctcaatatacattttactacccaatctgctctggacattaaactccaaaaattagaatctggcccccaaaccccacaacagggcttaaataacctcaccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccccaggagcttgctacatgtgccggaaatctggccactgggccaaggaatgcccgcagcctgggattcctcctaagccatgtcccatctgtgtgggaccccactgaaaatcggactgttcaactcacctggcagccactcccagagcccctggaactctggcccaaggctctctgactgactccttcccagatcttctcagcttagcggctgaagactgacactgcctgatcgcctcggaagccccctagaccatcaaggacgccgagcttcaggtaactctcacagtggaaggtaagcccatccccttcttaatcaatacggaggctacccactccacattaccttcttttcaatggcctgtttcccttgcctccataactgttgtgggtattgatggccaggcttctaaacctcttaaaactccccagctctggtgccaacttagataatactcttttaagcattcctttttagttatccccacctgccctgttcccttattaggctgagacactttaactaaattatctgcttccctgactattcctggactacagctatatctcattgccgcccttctccccaatccaaagcctcctttgcgtcctcctcttgtattcccccaccttaaccctcaagtataagatacctctactccctccttggcgaccgatcatgcaccccttaccatctcattaaaacctaatcacccttaccctgctcaatgtcaggatcccatcccacagcatgctttaaaaggattaaagcctgttatcactcacctgctatagcatggccttttaaagcctataaactctccttacaattcccccattttacctgtctaaaaccagacaagccttacaagttagttcaggatctgcgccttatcaaccaaattgttttgcctatccaccccatggtgccaaacccatatactctcctatcctcaatacctccctctactacccattattctgttctggatctcaaacatgcttttttttactattcctttgcacccttcatcccagcctctctttgctttcacttagactgaccctgacaccagttaggctcagcaaattacctgggctgtactgctgcaaggcttcacagacagcccccattacttcaatcaagccaaaatttcatcctcatctgttacctatctcagcataattctcataaaaacacatgtgctctccctgctgatcgtgtccgattaatctcccaaacctcaatcccttacaaagcaactcctttccttcctaggcatggttagcgcggtcagaattcttacacaagagccaggaccgcaccctgtagcctttctgtccaaacaacttgaccttactgttttagcctagccctcatgtctgcgtggagcggctgccgctgctttaatattttttgaggccctaaaaatcacaaactatactcaactcactctctacatttctcataacttccaaaatctattttcttcctcatacctgacgcatgtactttctgctccccggctccttcagctgtactcactctttgttaagtcccacaattaccattgttcctggcccggacttcaatctggcctcccgcattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttaaaacctctcattttctttccatcatagaaatctatcctcaaggaaataacttctcagtgttccatctgctattctactactcctgaaggattattcaggccccctcccttccctacacatcaagctcgaggatttgcccccgcccagtactggcaaattagctttactcaacatgccccgagtcacaaaaactaaaatacctcttagtctaagtagacactttcactagataagtagaggcctttcctacagggtctgagaaggccaccacagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacttcaccaagctcagccaccaacttaaaaaggactggacaatacttttaccactttcccttctcagaagtcagacctgtcctcagaatcctacaaggtacagcccatttaagctcctgtatatacgctcctttttattaggccccagtctcattccagacaccagaccaacttagactgtgccccaaaaaacttgtcatccctactatcttctgtctagtcatactcctattctccgttctcaactactcatacatgccctgctcttgtttacactgccagtttacactgtttctccaagccatcacagctgatatctccttgtgctatccccaaactgccactcttaactcttgaagtaaataaataatctttgctggcaggactatgctgaatctccttaggcactctaatcagatgtcctaggtcctcccaattcttagaccttttccatttagtttttcaattcatacaaaacatatccaggccatcaccaatcattctacacgacaaatgtttcttctaacaaccccacaatatcaccccttaccacaagatcttccattcagcttaatctctcccactctaggttcccacgccgcccctaatcccgcttgaagcagccctgagaaacatcgcccattctctctccataccaccccccaaaaatttttgccgccccaacacttcaacactattttgttttatttttcttattaatataagaaggcaggaatgtctggcctctgagcccaagccaagccatcacgtcccctgtgacttgcacctatatgcccagatggcctgaagtaactgaagaatcacaaaagaagtgaaaaggccctgccccgccttaactgatgacattccaccattgtgatttgttcctgccccaccttaactgagtgattaaccctgtgaatttctttctcctggctcagaagctcccccactgagcaccttgtgacccccccccacctcccctgcccaccagagaacaaccccctttgactgtaattttccattaccttcccaaatcctataaaacggccccacccccatctcccttcgctgactctcttttcggactcagcccacctgcacccaggtgaaataaacagccatgttgctcacacaaagcctgtttggtggtctcttcacatggacgcgcatgaaa

SEQ ID NO: 18 - DNA, 410 bp, Homo sapiens
gtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaagcctgtttggtggtcgcttcacacagacacgagtgaaa

SEQ ID NO: 19 - DNA, 2187 bp, Homo sapiens
tgcggtcagaattcttacacaagagccaggaccgcaccctgtagcctttctgtccaaacaacttgaccttactgttttagcctagccctcatgtctgagtgcagcgtctgccgctgctttaatactgttagaggccctaaaaatcacaaactatgctcaactcacgctctacatttctcataacttccaaaatctattttcttcctcatacctaacgcatatactttctgctccctggctccttcagctgtactcactctttaagtcccacaattaccattgttcctggcccggacttcaatctggcctctcacattattcctgataccacacctgacccccatgactgtatctctctgatccacctgatattcaccccatttccccatatttccttctttcctgttcctcaccctgatcacgcttgatttattgatggcagttccaccaggcctaattgccacacaccagcaaaagcaggctatgctatagtacaagccactagcccgcctctcagaacctctcatttcctttccatcctggaaatctatcctcaaggaaataacttcacagtgttccatctgctattctactactcctcagggattattcaggccccctcccttccctacacatcaagctcgaggatttgcccccacccaggactggcaaattagctttactcaacatgcccaagtcaggaaactaaaatacctcttagtctaaatagacactttcactgaataagtaaaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcgcttctcagaattcaggcctgtcctcagaatgttacaaggtacagcccatttaagctcctgtatagacagacgctcctttttattaggccccagtctcatttgacaccagaccaacttagactgtgccccaaaaaaacttgtcatccctactatcttttgtctagtcatactcctattcaccattctcaactactcatacctgccctgctcttgtttacactgccggtttacactgtttctccaagccatcacagctgatatctcctggtgctatccccaaacccccactctaaactcttgaagtaaataaataatctttgctggcaggactatgctgaatctccttaggcactctctaatcagatgtcctaggacctcccaattcttagaccttttatacctgtttttctccttctcttattacatttagtttttcaattcatacaaaaccgtatccaggccatcaccaataattctaaatgacaaatgtttcttctaacaaccccacaatatcaccccttaccacaagatcttccttcagcttaatctctcccacactaggttcccacaccgcccctaatcccgcttgaagcagccctgagaaacattgcccattctctctccataccacccccaaaaattttcgctgccccaacacttcaacactattttgtttcatttttcttattaatataagaaggcaggaatgtcaggcctctgagcccaagccaagccatcacatcaactgtgacttgcacatatacgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagatgctcccccactgagcaccttgtgacccccgcccctgcccaccagagaacaacccccctttgactgtaattttccattaccttcccaaatcctataaaacggccccacccttatctcccttcactgactctcttttcggactcagcccgcctgcacccaggtgaaataaaacagccatgttgctcccacaaagcctgtttggtggtctcttcacacggatgcacatgaaa

SEQ ID NO: 20 - DNA, 5899 bp, Homo sapiens
gtcaggcctctgagcccaagccaagccatcgcatcccctgtgacttgcacgtatacatccagatggcctgaagtaactgaagatccacaaaagaagtaaaaatagccttaacagatgacattccaccattgtgatttgttcctgccccaccctaactgatcaatgtactttgtaatctcccccacccttaagaaggttctttgtaattctccccacccttgacaatgtactttgtgagatccaccctgcccacaaaacattgctcttaacttcactgcctatcccaaaacctataagaactaatgataatccaccaccctttgctgactctcttttcggactcagcccgcctgcacccaggtgaaataaacagccatgttgttcacacaaagcctgtttggtggtctcttcacacggatgcacatgaaatttggtgccgtgactcggatcgggggacctcccttgggagatcaataccccgtcctcctgctctttgctccgtgagaaagatccacctacgacctcaggtcctaagaccgaccagcccaagaaacatctcaccaatttcaaatccagtaagcggcctctttttactctcttctccaacttccctcactatccctcaacctctttcttctttcaatcttggcgctacacttcaatctctcccttctcttaatttcaattcctttaattttctggtagagacaaaagagacatgttttatccgtggacccaaaactccagcgcctgtcatggactgggaaggcagccttccctttgtgtttaatcattgcagggatgcctctctgattatacacccatgtttcaagggtgtcagaccacgcagggacacttgccttggtccttcacccttagcggcaagtcccgcttttcttgggaaggggcaagtaccccaatcccttctctccttgtctctaccccttctctgcttctctggggaaggggcaagtaccccaaccccttctctccttgtctctaccccttctctgcttttctggggaaggggcaagtacccctcaacccccttctccttcacccttagcggcaagtcccgctttcctagagggcaagaacccccccaatcgcttatttctgcaccccaacctcttatctctgtgctccaatcccttatttccacaccctgaccttttatctctgtgccccaatcccttatttccatgccccaaccccttctctgcttttctggagggcaagaaccccccaccccttctccgtgtctctactcttttctctgggcttgcctccttcactatgggtaagcttccaccttccattcctccttcttctcccctagcctgtgttctcaaaaacttaaaacctcttcaactcacacctgacctaaaacctaaatgccttattttcttctgcaatgccgcttgaccccaatacaaactcaacagtagttccaaatagccagaaaatggcactttgaatttttccatcctgcaagatctaaataattcttgttgtaaaataggaaaacggtctgaggtgcctgacatccaggcattcttttacacatcagtcccttcctagtctctgtgcccagtgcaactcatcccaaatctttcttctttccctcctgcctgtcccctcagtcccaaccccaagcgtcactgagtctttctaatcttccttttctacagacccatctgacctctcccctcctcgccaggccgagctaggtcccaattcttcctcagcctccgctcctccaccctataatctttttatcacctcccctcctcacacctggtccggcttgcagttttgttccatgactagccctcccccacctgcccagcaatttaatcttaaaaagccaaaggcatagtcaaggttaatgctcctttttctttatcccaaatcagatagcgtttaggctctttttcatcaaatataaaaatccagctcagttcatgacttgtttggcagcaaccctgagatgctttacagccctagaccctaaaaggtcaaaaggccatcttattctcaatatacattgtattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacgcctgaactgcagtggccaggcgttcctccagaacctcctcccacaggagcttgctacacgtgccggaaatccggccactgggccaaggaatgcccgcagcccaggattcctcctaagccgcgtcccatctgtgtgggaccccactgaaaatcagactgttcaactcacctggcagccactcccagagcccctggaactctggcccaaggctctctgactgactccttctcagatcttctcggcttagtggctgaagactgacactgcccgatcgcctcggaagccccctaaaccatcacggatgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctacttccctgactattcctggactacagctatatctcattgccacccttcttcccaatccaaagcctcctttgcatcctcctcttgtatccccccaccttaacccacaaatatgagatacctctactccctccttggcgactgatcatgcaccccttaccatctcattaaaacctaatcacccttaccccactcaacgccaatatcccatcccacagcatgctttaaaaagattaaagcctgttatcactcgcttgctacagcatggccttttaaagcctataaactttccttacaattcccccattttacctgtcctaaaaccagacaagccttacaagttagttcaggatctgctccttatcaaccaaattgttttgcctatccaccccatggtgccaaacccatatactctcctatcctcaatacctgcctctacaacccattattctgttctagatctcaaacatgctttctttaccattcctttgcacccttaatcccagcctctcttcactttcacttggactgaccctgacacccatcaagctcagcaaattacctaggctgtacggctgcaaagcttcacagacagcccccattacttcaatcaagcccaaatttcttcctcatctgttacctatcttggcataattctcataaaaacacacgtgctctccctgccaatcgtgtctgactgatctctcaaaccccagcaccttctacaaaacaacaactcctttccttcctaggcatggttagtgcagtcagaattcttacacaagagccaggaccgcaccctgtagcctttctgtccaaacaacttgaccttactgttttagcctagccctcatgtctgcgtgcagtggctgccgctgcattaatacttttagaggccctcaaaatcacaaactatgctcaactcactctctacagttctcataacttccaaaatctattttcttcctcatacctgacgcatatactttctgcttcccagctccttcagctgtactcactctttgttaagtcccacaattaccattgttcctggcccagacttcaatctggcctcccacattattcctgataccacacctgacccccatgactgtatctctctgatccacctgatattcaccccatttccccatatttccttctttcctgttcctcaccctgatcacgcttgatttattgatggcagttccaccaggcctaatcgccacacaccagcaaaggcaggctatgctatagtacaagccactagcccgcctctcagaacctctcatttcctttccatcgtggaaatctatcctcaaggaaataacttctcagtgttccatctgctattctactacccctcagggattgttcaggcctcctccctttcctacacatcaagctcgaggatttgcccctgcccaggactggcaaattgactttactcatatgcctcgagtcagaaaactaaaatatctgttagtctgggtagacaccttgactggatgggtagaggccttccccacagggtctgagaaggccaccacagtcatttcttcccttctgtcggacataattcctcggtttggccttcccacctctatacagtctgataacggaccagcgtttactagccaaattacccaagcagtttctcaggctcttggtattcagtggaaccttcatatcccttaccatcctcaatcttcaggaaaggtggaacggactaatggtcttttaaaggcacacctcaccaagctcagcctccaacttaaaaaggattggacagtacttctacctcttgctcttctcagaatcagagcctgtcctccagatgctacagggtacagtccatttgaacttttatagggatgcactttcttgcttggccctaacctcatccagacaccagccctctaggcgactatcttccagtcctccagcaggctagacagcaaattcgccaggctgctaatcttctcttgcctactccagatccccagccatatgaagacaccctagctggatgatcagttcttgttaagaatctgacccctcaaactctacaacctcgatggaccggaccctacttagtcatctatagtaccccgactgccatccgcctgcaggatcctccccactggtttcaccattccagaataaagctgtgtccattggacagctagcctaatccctcctcttcctcctggaagtcgcaagtactttcccctacttcccttaaactcactcgtatttctgaagaacagtaataacacttatgagcctaatacatcccttcattctattagatcttttcgtccttaccctactttttgcaacagggctttacgaagccacccccaccacttagactgtgccccaaaaaaacttgtcatccctactatcttttttctagtcatactcctattcaccgttctcaactactcatacatgccctgctcttgtttacactgccggtttacactgtttctccaagccatcacagctgatatctcctggtgctatacccaaactgccactctaaactcttgaagtaaataaataatctttgctggcaggactatgctgaatctccttaggtactctctaatcagatgtcctaggtcctcccaattcttagaccttttatacctgtttttctccttctcttattccatttagtttctcaattcatccaaaaccgtatccaggccatcgccaatcattctatacaacaaatgtttcttcttacatccccacaatatcaccccttaccacaagacctcccttcagcttaatctctcccattctaggtttccacgccaccccaatcccgcctgaagcagccctgagaaacatctcccattctctctccataccaccccccaaaaatgttcaccgccccaacacttcaacactattttgttttatttttcttattaatataagaaggcaggaatgtcacgcctctgagcccaagccaagccatcgcatcccctgtgtgacttgcacgtatacatccagatggcctgaagtaactgaagatccacaaaagaagtaaaaatagccttaactgatgacattccaccat

SEQ ID NO: 21 - DNA, 5191 bp, Homo sapiens
gtcaggcctctgagcccaagccaagccatcgcatctcctgtgacttgcacctatacgcccagatggcctgaagtaactgaagaatcacaaaagaagtgaaaaggccctgccccgccttaactgatgacattccaccattgtgatttgttcctgccccaacttaactgaatgattaaccctgggaatttccttctcctggctcagaagctcccccactgagcaccttgtgacccccgcccctgcccaccagagaacaaccccctttgactgtaattttccattaccttcccaaatcctataaaacggccccacccctatctccctttgctgactctcttttcggactcagcccacctgcacccaggtgaaataaacaaccatgttgctcacacaaagcctgtttggtggtctcttcacacggacgcacatgaaatttggtgccgtgactcggatcgggggacctcccttgggagatcaatcctccgtcctcctgctctttgctccatgagaaagatccacctacgacctcaggtcctcagactgatcagcccaagaaacatctcaccaatctcaaatccggtaagtggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgcagggacacctctctgattatacactcacatttcaagggtgtcagaccacacagggacgcctgccttggtccttcacccttagtggcaagtcccgcttttctggggaagggtcaagtaccccaaccccttctcttgtctctaccccttctctgcttttctggggcaggggcaagtacccctcaaccccttctccttcacccttagcggcaagtcccgctttcctagggggcaagaaccccccaatcccttatttccacaccccaacctcttatctctgcgccccagtcccttatttccacgccccaacctcttgtctctgcgccccaatcccttatctctgcgccccaatcccttatttccacaccccaacctcttatctctgcgccccagtcccttatttccacgccccaacctcttatctctgcgtcccaatcccttatttccacgccccaacctcttatctctgcgccccaatcccttatctctgcgccccaatgccttatttccgcgccccgacccccccctcccgcttttctggaaggtaagaacccccgaaccccttccctccgtgtctctacgctctcttttctctgggcttgcctccttcactatgggcttgcctccttcactatgggcaagcttccaccttccattcctccttcttctcccttagcctgtattcttaagaacttaaaacctcttcaactctcacctgacctaaaatctaggcgtcttattttcttctgcaatgccgcttgaccccaatacaaactccacagtagttccaaatagccggaaaacggcactttcaatttttccatcctacaagatctaactaattcttgtcgtaaaatgggcaaatggtctgagatgcctgacgtccaggcattcttttacacatcagtccattcctagtctctgtgcccaatgcaactcgtcccaaatctcccgcctgtcccctcagtcccaaccccaagcgtcgctgagtctttctaatcttccttttctacagacccatctgacctctcccctcctcgcctggccaagctaggtcccaattcttcctcagcctccactcctccaccctataatccttttatcgcctcccctcctcacacctgctccggcttacagtttcattccgtgactagccctcccccacctgcccagcaatttactcttaaaaaggtggctggagctaaagacatagtcaaggttaatgctcctttttctttatcccagatcagatagcgtttaggctctttttcaccaaatataaaaacccagttcatggctcgtttggcagcaaccctgaggcgcttcacagccccagaccctaaaaggtcaaaaggccgtcttattctcaatatacattctattacccaatctgctcccgacattaactccaaaaattggaatctggccctcaaaccccacagcaggacttaattaacctcaccttcaaggtgtacaataacagaaaaaagttgcaattccttgcctccactgtgagacaaaccccagccacatctccagcacacaagaacttccaaacgcctgaactgcagcagccaggcgttcctccagaacctcctcccccaggagcttactacaagtgccagaaatctggccaccaggccaaggaatgcctgcagcccaggattcctcctaagccgtgtcccatctgtacgggaccccactggaaatcggactgttcaactcacctggcagacactcccagagcccctggaactctgacccagggctctctgactgactccttcttggcttaccggctgaaaactgacgctgcctgatcgcctcggaagccccgtagaccatcacggacgccgagctttaggtaactctcacagtggaaggtaagtccgtccccttcttaatcaatatggaggctacccactccacattaccttcttttcaagggcctgtttcccttgcctccataactgttgtgggtattgacagccaggtttctaaacttcttaaaactccccaactctggtgccaacttagacaacactcttttatgcactcttttttagttatctccacctgcccagttcccttattaggccgagatattttaaccaaatgatctgcttccctgactattcctggactacagccacatctcattgctgcccttcttcccaatccaaagcctcctttgcgtcctcctcttgtatcccccaccttaacccacaagtataagatacctctactccctccttggtgaccgatcatgcaccccttaccatctcattaaaacctaatcacccttaccccgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccctatgatgccaaacccatatactctcctatcctcaatacctccctccacaatccattattctgttctggatctcaaacgtgctttctttactactcctttgtacctgtcatcccagcctctcttcgctttcacttggactgaccctgacactcatcaggttcagcaaattacctgggctgtactgccgcaaggcttcacagacagcccccattacttcagtcaagcccaaatttcatcctcatctgttacctatctcggcataattctcgtaaaaacacacgagctctccctgctgatcgtgtctgattaatctcccaaacctcaatcccttacaaaacaacaaactcctttccttcctaggcatggttaatgcagtcagaattcttacacaagagccaggaccgcaccctgtagcctttctgtccaaacaacttgaccttactgttttagcctagccctcatgtctgcgtgcagcggctgccgctgctttaatacttttagaggcctttcctacaaggtctgagaaggccaccgtagtcatttcttcccttctgtcagacataattcctcagtttagccttcccacctctatacagtctgataacagaccagcctttattagtcaaatcagccaagcattttttcaggctcttagtattcagtgacagactaatggtctattaaaaacacacctcaccaagctcagccaccaacttaaaaaggactggacaatacttttaccactttcccttctcagaagtcagacctgtcctcagaatgctacaaggtacagcccatttaagctcctgtatagacgctcctttttattaggccccagtctcattccagacaccagaccaacttcgactatgcccccaaataacttgtcatccctactatcttccgtctagtcatactcctattcaccattctcaactactcatacatgccctgctcttgtttacactgccggtttacactgtttctccaagccatcacagctgatatctcctcgtcctatccccaaactgccactcttaactcttgaataaataatctttgctggcaggactatgctgaacctccataggcactctctaattagatgtcctaggtcctcccaattcttagtccttttatacctgtttttctccttctcttattccacttagtttttcaattcatacaaaaccgtatccaggccatcaccaatcattctatacgacaaatgtttcttctaacaaccccacaatatcaccccttaccacagatctcccttcagcttaatctctcccactctaggttcccacaccgcccctaatcctgcttgaagcagccctgagaaacatcacccattctctctccataccaccccccaaaaattttcgccgccccaacacttcaacactattttgttttatttttcttattaatagaagaaggcaggaatgtcaggcctctgagcccaagccaagccatcgcatcccctgtgatttgcacctatacgcccagatggcctgaagtaactgaagaatcacaaaagaagtgaaaaggccctgccccgccttaactgacgacattccaccattgtgatttgttcctgccccaacttaactgagtgattaaccctgggaatttccttctcctggctcagaagctcccccactgagcaccttgtgacccccgcccctgcccaccagagaacaaccccctttgactgtaattttccattaccttcccaaatcctataaaacggccccacccctatctcccttcgctgactctcttttcggactcagcccacctgcacccaggtgaaataaacaaccatgttgctcacacaaagcctgtttggtgttctcttcacacggacgcgcatgaaa

SEQ ID NO: 22 - DNA, 5854 bp, Homo sapiens
gtcaggcctctgagcccaagccaagccatcgcatcccctgtgacttgcacatatacgcccagatggcctgaagtaactgaagaagcacaaaagaagtgaaaaggccctgtcccgccttaactgatgacattccaccattatgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctatgaaacggccccattcctatctcccttcactgactctcttttcggactcagcccgcctgcaccgaggtgaaataaacagccatgttgctcacacaaagcctgtttggtggtctcttcacacggacttgagtgaatttggtgctgtgactcggactgggggacctccgttgggagatcaatcccccgtcctcctgctctttactccatgagaaagatccacctatgacctcaggtcctcagaccaaccagcccaagaaacatctcaccaatttcaaatccagtaagtggcctctttttactctcttctccatcttccctcactatccctcaacctctttctcccttcaatcttggggtcacacttcaatctctcccttctcttaatttcaattcctttcattttctggtagagacaaaggagacacgttttatccatggacccaaaactccggcgccggtcacggactgggaaggcagacttcccttggtgtttaatcattgcagggacacctctctgattattcacccacatttcaaaggtgtcagaccacacagggatgcctgccttggtccttcacccttcgcggcaagtcctgcttttctgggggaggggcaagtacccctcaaccccttctccttcacccttagcggcaagtcccgcttttctggaggaggggcaagtaccccaaccccttctctccgtgtctctaccccttctctgattttctggggcaagggcaagaacccctcaaccccttctccttcccctcagtggcaagtcccgcttttctaggggaggggcaagtaccccaaccccttctctccgtgtctctaccccttctctgcttttctggaggagaggcaagtaccccaacctcatatctctgcaccccgatcccttatttccacaccctgacctcgtatctctgcgccctgaccccttctctgcttttctggaggacaagaaacccccaccccttctctgtgtctctactcttttctctgggcttgcctccttcactatgggcaagcttccaccttccattcctccttctcccttagcctgtgttcttaagaacttaaaacgtcttcaactgtcacctcacctaaaatctaagtgtcttattttcttctgcaatgccgcttgaccccaatacaaactcgacagtagttccaaatagccggaaaacagcactttcaatttttccatcctacaagatctaaataattcttgttgtaaaatgggcaaatggtctgaggtggctgacatccaggcattctttcacacatcagtcccttcctagtctctgtgcccagtgcaactcatcccaaatcttccttctttccctcccgcctgtcccctcagtcccaaccccaagcgtcgctgagtctttctaatcttccttttctacagacccatctgacctctcccctcctcaccaggccaagctaggtcccgattcttcctcagcctccgctcctccaccctataatctttttatcgcctcccctcctcacacctggtccagcttacaatttcgttccatgagtatccctcccccacctgcccagcaatttactcttaaaaacgtggctggagccaaaggcatagtcaaggttaatgctcctttttctttattccaaatcagaagcgtttaggctctttttcatcaaatataaaaacccagcccagttcatggctcattcggcagcaaccctgagacgctttacagccctagaccctaaaaggtcaaaaggccatcttattctcaatatatattttattacccaatccgctcccgacattaaataaaactcccaaagttggaatctggccctcaaaccccacaacaggacttaattaacctcaccttcaaggtgtacaataataaaaaaaaagttgcaattccttgcctctactgtgagacaaaccccagccacatctccagcacacaagaacttccaaacgcctgaaccgcagcagccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactgactccttctcggcttagcagctgaagactgacactgcccgaccacctcgaaagccccgtagaccatcacagacgccgagcttcaagtaactctcacagtgcaaggtaagtccgtccccttaatcaatatggaggctacccactccacattaccttcttttcaaggtcctgtttcccttgcctccgtaactgttgtaggtattgacggccaggcttctaaacctcttaaaactccccaactctggtgccaacttagacaatactcttttaagcactccttttagttatccccacctgcccagttcccttattaggccgagacactttaaattatctgcttccctgactattcctggattacagctgcatctcattgccgcccttcttcccaatccaaagcctcctttgcatcctcctcttgtattcccccaccttaacccacaagtataagatacctctactccctccttggcgactgatcatgcaccccttaccatctccttaaaacctaatcacccttaccccactcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctatgccttatcaaccaaattgttttgcctatccaccctatggtgccaaacccatatactctcctatcctcgatacctccctccacaatccattattctgttctggatctcaaaaatgctttctttactattcctttgcacccatcatcccagcctctctttgctttcacttggactgaccctaacacccattaggctcagcaaattacctgggctgtactgccccaaggcctcacagacagcccccattacttcagtcaagcccaaatttcatcctcatctgttacctatctcagcataattattcataaaaacacaggtgttctccctgttgattgtgtccgattaatctcccaaacctcaattccttacaaaacaacaactcctttccttcctaggcatggttaatgtggtcagaattcttacacaagagccaggaccgcaccctatagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgatgcatatactttctgctccccggctccttcagctgtactcactctttgttaagtcccacaattaccattgttcctggcccggacttcaatctggcctcccacattattcctgataccacacctgacccccatgactgtatctctctgatccacctgacattcaccgcatttccccgtatttccttctttcctgttcctcaccctgatcacgcttgatttattgatggcagttccaccaggcctaattgccacacaccagcaaaggcaggctatgctatagtacaagccactagcccacctcttagaacctctcatttcctttccattgtagaaatctatcctcaaggaaataacttctcagtgttccatctgctattctactactcctcaaggattattcaggccccctcccttccctacacatcaagcccggggatttgcccctgcccaggactagcaaatttgctattctactactcctcaaggattattcaggccccctcccttccctacacatcaagttcaaggatttgcccctgcccaggactgtcatattagctttactcaacatgccccgagtcacaaaacctaaaatacctcttagtctaagtagacgctttcactagataggtagagacctttcctacagggtctgaggccaccgcagtcatttcttcccttctgtcagacataattcctcagtttagccttcccacctctatacagtctgataacagaccagtctttattagtcaaatcagccaagcagtttttcaggctcttaatattcagtgaaacctttatatcccttatagtcctctgtctttaagaaaagtagaacagactaaaggtcttttaaaaacacacctcaccaagctcagccaccaacttaaaaagaactggacaatacttttaccactttcccttctcagaagtcagacctgtcctcagaatgctacaaggtacagcccatttaagttcctgtatagatgctcctttttattaggccccagtctcattccagacactggatcaacttagactgtgcccccaaaaaaacttgtcatccctactattttctgtctagtcatactcctattctccattctcaactactcatacatgccctgctcttgtttacactgccagtttacactgtttctccaagccatcacagctgatatctcctcgtgctatccccaaaccgccactcttaactcttgaagtaaataaataatctttgctggcaggactatgctgaatctccttaggcactctctaatcagatgtcctaggtcctcccaattcttggaccttttatacctgtttttctccttctcttattccatttagtttttcaattcatacaaaactgtatccaggccatcaccaataattcgaaatgacaaatgtttcttctaacaaccccacaatatcacccctttctacaaaatcttccttcagcttaatctctcccactctaggttcccacgctgccccaatcccacttgaagcagccctgagaaacatcgtccattctctctccataccaacccccaaaaattttcgccaccccaagacttcaacactattttatttttcttattaatataagaaggcaggaatgtcaggcctctgagcccaagccaagccatcgcatcccctgtgacttgcacatatacacccagatggcctgaagtaactgaagaatcataaaagaagtgaaaaggccctgccccgccttaactgatgatattccaccattgtgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctataaaacggccccacccctatctcccttcacttgactcttttcggactcagtccacctgcaccgaggtgaaataaacagccatgttgctcacacaaagcctgtttggtggtctcttcacacggactcgagtgaaa

SEQ ID NO: 23 - DNA, 3769 bp, Homo sapiens
aattgaagatccacagaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaacagccccacccctatctcccttcacttgactctcttttcagactcagcccacctgcacccaggtgaaataaacagctttattgctcacacgaagcctgtttggtggtctcttcacacggatgcgcatgaaatttggtgccgtgacttggatcgggggacctcccttaggagatcaatcccccgtcctcctgctctttgctccgtgagaaagatccacctacgacctcaggtcctcagaccgaccagcccaagaaacatctcaccaatttcaaatctggtaagcggcctctttttactctcttctccattcctcctccttctcccttagcttctccaacctccctcactatccctcaacctctttctcctttcaatcttggcgccacacttcaatctctcccttctcttaatttcaattcctttcattttctggaagagacaaaagagacatgttttatccgtgaacccaaaactccggcgctggtcacggactgggaaggcagccttcccttggtgtttaatcattgcagggacgcctctctgattatacactcacgtttcaagggtgtcagaccacgcagggacgcctgccttggtccttcacccttagcggcaagtcccgctttcctggggcaggggcaagtacccctcaaccccttctccttcaccctcagcggcaagtcccgcttttctggggcaggggcaagtacccctcaaccccttccccttcacacttagtggcaagtcccgctttcctggggcaggggcaagtacccctcaacgccttctccttcacccttagtggcaagtcccgcttttctagggggcaagaacccccaaaccccttccatctgtgtctctacgctctcttctgtgggtttgcttccttcactatgggcaaccttccaccctccattcctccttcttctcccttagcctgtgtgctcaaaaagttaaaacctcttcaactcacacctgacctaaaacctaaatgccttattttcttctgcaacaccgcaaccgcttggccccaatacaaacttgacaatgtctctaaatggccggaaaatggcactttcgatttctccatcctacaagacctaaataatttttgtcgaaaaatgggcaaatggtctgaggtgccttacgtccaggcatttttcacacttcgttccctccctagtctctgttcccaatgcgattcctcccagatcctcctcctttccctcccgcctgtcccctcggtcccaaccccaagcgtcgctgagtcttcccagtcttccttttctacagacccatctgacctttcccctcctccccaagctgcttgtcgccagaccgagctaagtcccaatacttcctcagcctccactcctccaccctataatccttctatcacctcccctcctcacacctggtccggcttacagtttagttccgcgactagcgcttccccacctgcccaacaatttcctcttagagaagtggctggagctgaaggcatagtcaaggtacatgtacttttttctctatcagacctctctcagatcagtcaatgtttaggctctttctcatcagaccccactaaatatatacaggaattccaatatctaactctgtcctacaacttaacctggagtgacttaaatgtcatcctgacttctactctctccccagatgaacgggaaagttttttctctagcccaatctcgtgctgataaccgccggcttcatgagccagacctccaggaaggcattagagcagttccccgagaggatccccaatggaactatcaggcagattccccaggtacagctaggcgagattacatggtttcctgcctagttgaagggcttaaaaaagcagcttacaaagctgttaattatgacaagcttaaagaaactacccgaggtaaagacgaaaacccagcccaggtcatggcccacttagcagcaaccattagatgctatactgccctagacccagaggggccagaaggccgccttattcttaatatgcatttttatcacccaatccactcctgacattaggaaaaaacttcaaaaattagaatctggccttcaaacccagcaggaattaatcaaccttgccttcaaggtgtacaataatagagaggaagcagccagacggcaacgcatttcggagttacaattacttgcctctgctgtgagacaaaacccagccacacctcctgcatacaggaacttcaaaatgcctaagacgcagcaatcagacactcctacaagacttcatcaggatcttgcttcaagtgccagaaatctggccactgggccaaggaatgcccacagcccaggattcctcccaagccatgtcccatctgtgcaggcacccactggaaatcagactgcccagctcgcccgacagccactcctggagcccctaaagctctagcccaaggctctctgactccttcccagatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtgggtattgacggccaagcttcaaaacccctgaaaactcccccactctggtgccaacttggacaacactcttttatgcactcttttttagttatccccacctgcccacttcccttattaggccgaaatattttaaccaaattatctgcttccctgactattcctggagtacagctacatctcattgctgcccttcttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgattgtaattttttattaccttcccaaatcctataaaacagccccacccctatcttccttcactgactctcttttcggactcagcccaccggcacccaggtgaaataaacagctttattgctcacacaaagcctgtttggtggtctcttcacacggacgcgtatgaaa

SEQ ID NO: 24 - DNA, 5644 bp, Homo sapiens
gtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagaggctcccccactgagcaccttgtgaccactgcccctgcccaccagagaacaaccccctttggctgtaattttccattacctttccaaatcctataaaacggccccacccctatctcccttcgctgactctctttttggactcagcccacctgcacccaggtgaaataaacagccatgttgctcacacaaagcctgtttggtggtctcttcacatggacgcacatgaaatttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggtaagtggcctctttttactctcttctccagcttccctcactatccctcaacctctttctcctttcaatcttggcgccacacttcaatctctcccttctcttaatttcaattcctttcattttctggtagagagagacaaaagagacacgttttatccatggacccaaaactccggtgctggtcacggactgggaaggcagccttcccttggtgtttaatcattgcagagatgcctgattattcacccacgtttcaaaggtgtcagaccacgcagggacgcctgccttggtccttcacccttagcagcaagtcccgcttttctggggaagaggcaagtaccccaatcccttctctccttgtctctaccccttctctgcttttctgggggagggacaagtacccctcaactgcttctccttcacccttagcggcaagtcccgcttttctagggggcaagaacccccaatcccttatttccacaccccaacctcttatctctgtgccccaattccttatttccatgccccaaccctttctctgcttttctggagggcaagaaacccccaccccttctccgtgtctctactcttttctctggacttgcctccttcactatgggcaagcttccaccttccattcctccttcttctcccttagcctatattcttaagaacttaaaacctcttcaactctcacctgacctaaaatctgagcatcttattttcttctgcaatgcgcttgaccccaatacaaactcgacagtagttccaaatagccggaaaatggcactttgaatttttccatcctacaagatctaaataatccttgtcataaaatgggcaaatggtctgaggtgcctgacgtccaggcattcttttacacatcagtcccttcctagtctctgtgcccagtgcaactcgtcccaaatcttccttctttcccccctccgcctgtcccctcagtcccaaccccaagcgttgctgagtctttctaatcttccttttctacagacccatctgacccctcccctcctcgccaggccaagctaggtcccaattcttcctcagcctccgctcctctaccctgtaatctttttatcgcctcccctcctcacacctggtccggcttacagtttctttctgtgactagccctcccccacctgcccagcaatttactcttaaaaaggtggctggagccaaaggcatagtcaaggttaatgctcctttttctttatcccaaatcagaagcgtttaggctcttttttatcaaatataaaaacccagcccagttcatggctcgttcggcagcaatcctgagacgttttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataataaaaaaaaaaattgcaattccttgcctccactgtgagacaaaccccagccacatctccagcacacaagaacttccaaacgcctgaaccgcagcggccaggcgttcctccagaacctcctcccccaggagcttgctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgactccttcttggcttagcggctgaagattgatgctgcctcattgcctcagaagccccatagaccatcacggacgccaagcttccggtaactctcacagtggagggtaagtccgtccccttcttaatcaatacagaggctacccactccacattaccttcttttcaagggcctgtttcccttgcctccataactgttgtgggtattgacgccaggcttctaaacctcttaaaactccccaactctggtgctaacttagacaatactcttttatgcactcttttttagttatccccacctgcccagttcccttattaggccgagatattttaaccaaattatctgcttccctgactattcctggatatagccacatctcattgctgcccttcttctcaatccaaaagcctcctttgcttcctcctcttgtattcccccaccttaacccacaagtataagatacctctactccctccttggcgaccgatcacccaccccttaccatctcattaaaacctaatcacccttaccccactcaatgccaatatcccatcccacagcaagctttaaaaggattaaaacctgttatcacttgcctgctacagcatgggcttctaaaacctataaactctccttaccattcccccattttacctgtcctaaaaccagacaagccttacaagttagttcagaatctgcgccttatcaaacaaattgttttgcctatccactctatggtgccaaacccatatactctcctatcctcaatacctccctctactacccattattctgttctggatctcaaacatgctttctttactattcctttgcacccttcatcccagcctctctttgtcttcacttagactgaccctgacacccattaggctcagcaaattacccgggctgtactgccgcaaggcttcacagacagcccccaatacttcagtcaagcctaaatttcatcctcatctgttacctatctcggcataattctcataaaaacacacgtgctctccctgctgatcatgtccgattaatctcccaaacctcaatcccttactaaagaacaactcctttccttcctaggcatggttagtgcggtcagaattcttacacaagagccaggaccacatcgtgtagcctttctgtccaaacaacttgaccttactgttttagcctagccctcatgtctgcgtgcagcggctgccgctgctttaatacagttagaggccctaaaaatcacaaactatgttcaactcactctctacatttctcataacttccaaaatctattttcttcctcatacctgacgcatatactttctgctccccggctccttcagctgtactcactctttaagtcccacaattaccattgttcctgccccggacttcaatctggcctcccacattattcctgatgccacacctgacccccatgactatctctctgatccacctgatattcaccccatttccccatatttccttctttcttgttcctcaccctgatcatgcttgatttattgatggcagttccaccaggcctaatcgccacacaccagcaaaggcaggctatgctatagtacaagccactagcccgcctctcagaacctctcatttcctttccatcgtggaaatctatcctcaaggaagtaacttctcagtgttccatctgctattctactactcctcaggcattattcaggccccctcccttccctacacatcaagctcgaggatttgcccccacccaggactggcaaattagctttactcaacatgtcctgagtcaggaaactaaaatacctcttagtctaaatagacactttcactgaataagtaaaggcctttcctacagggtctgagaaggtcaccacagtcatttcttcccttctgtcagacataattcctcagtttagccttcctacctctatacagtctgataacagaccagcctttattagtcaaatcagccaagcagtttttcaagctcttagtattcagtgaaacctttatatcctttacggtcctccgtcttcaagaaaagtagaacggactaaaggtcttttaaaaacacacctcaccaagctcagccaccaacttaaaaaggactggacaatacttttatcactttcacttcccagaattcaggcctgtcctcagaatgctacaaggtacagcccatttaagctcctgtatagacagacgctcctttttattaggccccagtctcatttgacaccagaccaacttagactgtgccccaaaaaaacttgtcatccctactatcttttgtctagtcatactcctattcaccattctgaactacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccatttagttttttaattcatacaaaaccgtatccaggccatcaccaatcattctatacgacaaatgttccttctaacaaccccacaatatcaccccttaccacaagatcttccttcagcttaatctctcccactctatgttcccacactgcccctaatcccgcttgaagcagccctgagaaaaatcgcccattctctctccataccacccccaaaaattttcgccgccccaacacttcaacactattttgtttaatttttcttattaatataagaaggcaggaatgtcaggcctctgagcccaagccaagccatcacatcccctgtgacttgcacgtatacacccagatggcctgaagtaactggagaatcacaaaagaagtgaaaaggccctgccccgccttaactgatgacattccaccattgtgatttgttcctgccccaccttaactgagtgattaaccctgtgaatttccttgtcctggctcagagtctcccccactgagcaccttgtgacccccgcccctgcccaccagagaacaaccccctttgactgtaattttccatttcctttccaaatcctataaaacggccccacccctatctcccttcgctgactctctttttggactcagcccacctgcacccaggtgaaataaacagccatgttgctcacacaaagcctgtttggtggtctcttcacatggacgtgcatgaaa

SEQ ID NO: 25 - DNA, 5687 bp, Homo sapiens
gtcaggcctctgagcccaagctaagccatcatatcccctgtgacctgcacatatacattcagatggcctgaagcaactgaagattcacaaaagaagtgaaaatagccttaactgatgacattccaccattgtgatttgtttctgccccaccctaactgatcaatgtactttgtgatctcccccacccttaagaaggttctttgtaattctccccacccttgagaatgtactttgtgagatccaccccctgcccgcaaaacattgctcctaactccaccgcctaccccaaaacctataagaactaatgataatcccaccaccctttgctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattgggtaagcggtcttttcactctcttctccagcctctcttgctacccttcaatctccctctctcgctacccttcaatctcccagtccttccaactccagttctttttcctctctagtagagacaaaggaaacacattttatctgtagactccagcgccagtcacggacttgggaagacagtcttcccttggtgtttaatcactgcggggacgcctgcctgattattcactcacactccattggtgtctgatcaccgcggggacgcctgccttggtcattcacccacattcctttggtggcaagtcaattgcggggacacctgctttggctgctcacctactcccttctccatgtctctacctttctctttaaacttacctccattactatgggcaaccttccaccctccattcccccatcttctcccttagcctgtgttctcaaaaacttaaaacctcttcaactctcgcctgacctaaaacctaagcgtcttattttcttctgcaacaccgcttggccccaatacaaactcaataatggttctaaatagctagaaaatgacacttttgatttctccattttacaagacctggatgatttttgttgaaaaatgggcaaatgggtctgatgtgcctgacatccaggcattgtttcatacactggtccctccttagtctctgctcccaatgcgactcatcccaaatctttcttctttctctgcggtctgttccttcagtctccaccccaagctctgagtcctttgaatgctccttttctacagacccatctaacctctcccctcctacccaggctgctcctcaccaggctgagccaggtcccaattcttcctcagcctccgctccccgatcctataatccttttatcacctcccctcctcacacccggtccagtttacagttacattcctccactagccctcccccacctgcccaacaatttcctcttaaagaggtggctggagctgaaggcatagccaaggtaaatgctcctttttccgacctctcccaaatcagggtttaggctctttttcatcaaatataaaaactcaacccagttcatggcccgtttggcaacaacccttagacggtttactgccctagacccagaagggccagaaggccgtcttattctcaatatgcattttattacccaatccactggcgacattagaaaaagctccaaaaattagattctggccctcaaaccccacaacgggacctaattaacctcaccttcaaggtgtacaataatagagtagaggcagccaagtagcaacgtatttctgagttgcaattctttgcctccaccgtgagacaaaccccagccacatctccagcacacaagaactccaaatgcctaaactgcggcggccaggcattcctccaggactgcctgccccaggatcttgcttcaagtgccagaaatctggccaccgggccaaggaatgcctgcagcctgggattcctcctatgccatgtcccatctgtgcgggaccccactggaaattggactgtccaacttacccggcagccactcccagagcccctggaactctggcccaaggctctctgactgattccttcccagatcttcttgacttagcagctgaagactgatgctgcccgattgccttggaagcccccctagaccatcacagatgccgagcttcgggaactctcacagtggagggtaagtccgaccccttcttagtcaatatggaggctactcactccacattaccttcttttcaagggcctatttcctttgcctccataactgttgtgggtattgatggccaggcttctagaccccttaaaactccccaactctgatgccaacttggacaacattcttttatgcgctcctttttagttatccccacctgcccagctcccttattaggctgagacattttaactaaattatctgcttccctgactattcctagcctatagcctcacctcatttacacccttttccccagttcaacacctccttcgcctcctccccttgtacctccccaccttaatccacaagtatagggcacctctactccctccttggcgtccaattatgcacctcttaccatcccattaaaacctaatcacccttaccccactcaatgccaatatcccatcccacagcatgctttaaaaggattaaagcctgttatcacttgcctgttacagcacggccttttacagcctataaactctccttacaattcctccattttacttgtccaaaaaccagacaagccttacaggttagttcaggatttgtgccttatcaaccaaattgtcttgcctatccaacctgtgatgccaaagccatatactctcctatcctcaatacctccctccacaacccattattctgttctggatctcaaacatgttgtctttactatttctttgcacccttcatcccagcctctcttcacttttacttgaactgaccctgacacccattaggctaagcaaattacctgggctatactgccacaaggcttcacagacagctcccattacttcagtcaagccgaaatttcttcctcatccgttacctatctcggcataattcttcatgaaaacacacgtgctctccctgctgattgtgtctggctaatctcccaaacccaaccccttctacaaaacaacaactcctttccttcctatgcatggttaggtacttccgcctttggatacctagttttaccatcctgactaaaccattatataaactcacaaaagcaaacctagctgaatccatagatcctaaatcctttccccactcctctttccattccttaaaaacagccctagaagctgctcccacactagctctccctaactcatcccgacccttttcattacacacagccaaactacagggctgtgcagtcaaaattcttacacaagagctgggaccacaccctgtagcctttccatccaaacaacttgaccttacctttttaggctagcctctacattattcctgataccacacctgacccccatggctgtatctctctaatccacctgacattcactccacttccccatatttccttctttcctggtcctcaccctgatcacacttggtttattgatggcagttccaccaggcctaattgccactcaccagcaaaagcaggctatgctatagtatcttccacatctatcattgaggctactgctctgcctccctccactacctctcagcaagccgaactcattgccttaactcgagccctcactcttgcaaaggaattacgtgtcaatatttatactgactccaaatatgccttccatatcctgcaccaccatgctgttatatgggctgaaagaggtttccttactacgcaagggtcctccatcattaatgcctctttaatgaaaactcttctcaaggctgccttacttccaaagaaagctggagtcatacactgtaagggccaccaaaaggcatcagatcccattgctaggggcagcacttatgctgataaggtagctaaagaagcagttagcattccaacttctatccctcacggcagtttttctccttctcatctggtcactcccacctactctcccactgaaacttccacctatcaatctcttcccacacaagcaaatgcttcttggaccaaggaaaatatctccttcttgcctcacaggcccattctattctatcgtcatttcataacctcttccatgtaggttacaagccgctagcccacctcttagaacctctcatttcctttccattgtggaaatctatccttaaggaaatcacttctcagtgttccatctgctattctactacccctcagggattgttcaggccccctcccttccctacacatcaagctcggggatttgccacccccaggactggcaaattgactttattcacatgcccaagtcaggaaactaaaatacctcttgatctgggtagacacttttgctggatgtgtagaggcctttcccactgggtctgagaaggccaccatggtcatttcttcccttttgtcagacataattcctcagtttggctttctcacctctatacagtccaataacagaccagcctttactagtcaaatacccaagcaatttctcaggctcttggtattcagtggaactttcatacccctgaccgtcctcaatcttcaggaaagataaaacagactaatggtcttttcccaaaaactcaccaaccaagtaagtaattacactggacccccttgggcactctctaattggatgtcctgggtcctcccaattcttagtcctttaatacctatttttctccttcttttattcagaccttatatcttctgtttaatttctcaattcatccaaaactgtatccaggccatcgccaatcattctatatgaaaaatgctccttctaatcacccacaatatcacccctgaccacaaaatcttccttcaacttaatctctcccactctaggttcccacaccacccctaatcccgctcgaagcagccctgagaaacatcgcccattatctctccataccacccccaaaatttttcacctctccaacacttaaccactattttgttttgcttttcttattaacataagaagacaggaatgtcaggcctctgagcccaagctaagccatcatatcccctgtgacctgcacgtatacatccagatggcctgaagcaactgaagatccacaaaagaaatgaaaatagccttaactgatgacattccaccattgtgatttgtttctgccccaccctaactgatcaatgtactttgtaatctccccaacccttaagaaggttctttgtaatctcccccacatcttaagaaggttctttgtaattctccccacccttgagaatgcactttgtgagatccactccctgcccacaaaacattgctcctaactccaccgcctaccccaaaacctataagaactaatgataatcccaccaccctttgctgactctcttttcggactcagcccacctgcacccgggtgaaataaacagccttgttgctcacacaaagcctgtttggtggtctcttcacacagacgtgcatga

SEQ ID NO: 26 - DNA, 5873 bp, Homo sapiens
gtcaggcctctgagcccaagccaagccatcgcatcccctgtgacttgcatgtatatgcccagatggcctgaagtaactgaagaatcacaaaagaagtgaaaaggccctgccccgccttatctgatgacattccaccattgtgatttgttcttgccccaccttaactgagtgattaaccctgtgaatttccttttcctggctcagaagctcccccactgagcaccttgtgacccccgcccctgcccaccagagaacaaccccctttgactgtaattttccattaccttcccaaatcctacaaaacggccccacccctatctccctttgctgactctcttttcggactcagcccacctgcacccaggtgaaataaacaaccatgttgctcacacaaagcctgtttggtggtctcttcacatggacgcgcatgaaatttggtgccatgactcggatcgggggacctcccttgggagatcaatcccctgtcctcctgttctttgctccgtgagaaagatccacctacaacctcaggtcctcagaccgaccagcccaaggaacatctcaccaattttaaatcaggtaagcggtctcttcttactctcttctccaacctctctcactgtccctcaaccactttctcctttccactcttcaatctctcccttctcttaatttcaattcctttcattttctgggagagacaaaggagacatgttttatccgtggacccaaaactccggcgccggtcacagactgggaaggcagctttcccttggtgtttaatcattgcagggacgcctctctgattattcacccacgtttcaaaggtgtcagaccacgcagggacgcctgtcttggtccttcacccttagcggcaagtcccgcttttctggggaaggggcaagtaccccaaccccttctctccttgtctctaccccttctctgcttttctggggaaggggcaagtaccccaacccttctctccttgtctctaccccttctctgcttttccgggggtggggcaagtaccccaaccccttctctccttctctccaccccttctctgctttcctggggcaggggcaagtaccactcaaccccttctccttcacccttagcggtaagtcccgctttcctagggggcaagaaccccccaatcgcttatttccatgccccaacctcttatctctgcgccccaatcgcttatttccatgccccaacctcttatctctgtgccccaattgcttatttccgcgccccaacctgttatctctgtgccccaatcccttacttccatgccccaacctcttatgtctgcaccccaatcccttatttccatgctccgaccctttctctgcttttctggtgggcaagaaacccccaccccttctccatgtctctactcttttctctgggcttgcctccttcactatgggcaagcttccaccttccattcctccttcttcttccttagcctgtattcttaagaacttaaaacctcttcaattctcacctgacctaaaatctaagcatctcattttcttctgcaatgccgcttgaccccaatacaaactggacagtagttccaaatagccagaaaacggcactttcaatttttccatcctataagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccctccttgccaggccaagctaggtcccaattcttcctcagcctccgctcctccaccctgtaatctttttattgcctcccctcctcacacctggtccggcttacagtttcgttccgtgactagcccttccccacctgcctagcaatttactcttaaaaaggtggctggagctaaaggcatagtcaaggttaatgctcctttttctttatcccaaatcagatagcgtttaggctctttttcatcaagtataaaaatccagcccagttcatggctcgtttgacagcaaccctgagacgctttatagccctagaccctaaaaggtcaaaaggccatcttattctcaatatacattttattacccaatctgctcccgacattaaataaaactccagaaattggaatctggccctcaaaccccacaacaggacttaattaacctcaccttcaaggtgtgcaataacagaaaaaagttgcaattccttgcctccactgtgagacaaaccccagccacatctccagcacacaagaacttccaaacgcctgaaccatagcaaccaggcgttcctccagaacctcctcccccaggcgcttgctacacgtgccggaaatctggccactgggccaaggaatgcccgcagcctgggattcctcctaagccgcgtcccatctgtgtgggaccccactgaaaatcggactgttcaactcacctggcagccactcccagagcccaaggaactctgggcccaaggctctctgactgactccttcttggcttaccggctgaagactgacgctgcctgatcacctcagaagccccgtagaccatcacggacgccgagctttaggtaactctcacggtggagggtaagtccatccccttcttaatcaatacggaggctacccactccacattaccttcttttcaagggcctgtttcccttgcctccataactgttgtgggtattgacagccaggcttctaaacctcttaaaactccccaactctggcgccaacttagacactactcttttaagcactcctttttagttatccccacctgcccagttcccttattaggctgaggcactttaagtaaattatctgcttccctgactattcctggactacagctatatctcattgccgcccttcttcccaatccaaagcctcctttgcgtcctcctcttgtatccccccaccttaacccacaagtataagacacctctactccctccttggcgactgatcatgcaccccttaccatctcattaaaacctaatcacccttaccccactcaacgccaatatcccatcccacagcacgctttaaaaggattaaagcctgttatcactcgcctgctacagcatggccttttaaagcctataaactctccttacaattcccccattttacctgtcctaaaaccagacaagacttacaagttagttcaggatctgtgccttatcaaccaaattgttttgcctatcccccttgtggtgcccaacccgaacactcttttgtcctcaataccttcctccacaactcactattccgtgcttgatcgtaaagatgcttttttcactgttcccctgcacccctcgtccccgcctctctttgctttcacttagactgaccctgacacccatcaggctcagcaaattacctgggctgtcctgccgcaaggcttcacagacagcccccattacctcagtcaagcccaaatttcatcctcatctgttacctatctcggtataattctcacaaaaacacacgtgctttccctgctgatcatgtctgattaatctcccaaacctcaatcccttacaaaacaacaactcctttccttcctaggcatggttagtgtggtcagaattcttacacaagagccaggaccgcaccctgtagcctttctgtccaaacaacttgaccttactgttttagcctagccctcatgtctgtgtgcagcggctgccgctgctttaatacttttagaggccctgaaaatcacaaactatgctcaactcactctctacatttctcaacttccaaaatctattttcttcctcatacctgacgcatacactttctgctccccggctccttcagctgtactcactctttgttaagtcccacaattaccactgttcctggcccggacttcaatctggcctcccacattattcctgataccacacctgacccccatgactgtatctctctgatccacctgctattcaccccatttccctgtatttccttctttcctattcctcaccctgatcacgcttgatttattgatggcagttccaccaggcctaatcgccacataccagcaaatgcaggctatgctatagtacaagccactagcctgcctctcagaacctctcatttcctttccatcgtggaaatctatcctcaagaaaataacttctcagtgttccatctgctattctactactcctcagggattattcaggccccctcccttccctacacatcaagctcgagaatttgcccccacccaggactggcaaattagctttactcaacatgcccgagtcaggaaactaaaatacctcttagtctaaatagacactttcactgaataagtaaaggcctttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccactttcacttctcagaattcaggcctgtcctcagaatgctacaaggtacagcccatttaagctcctgtatagatgctcctttttattaggccccagtctcattccagacactggaccaacttagactgtgcccccaagaaaacttgtcatccctactattttctgtctagtcatattcctattctccattctcaactactcacacatgccctgctcttgttcacactgccagtttacactgtttctccaagccatcacagctgatatctcctcgtgctatccccaaactgccactcttaactcttgaagtaaataaataatctttgctggcaggactatgctgaatctccttaggcactctctaatcagatgtcctaggtcctcccaattcttagaccttttatacctgtttttctccttcttattccatttagtttttcaattcacacaaaactgtatccaggccatcaccaatcatactatatgacaaatgtttcttctaacaaccccacaatatcaccccttaccacaagatctcctttcagcttaatctctcccactctaggttcccacccgcccctaatcccgcttgaagcagccctgagaaacatcgcccattctctctccataccaccccccaaaaattttcgccaccccaacacttcaacactattttgttttatttttcttattaatataagaaggcaggaatgtcagtcctctgagcccaagccaagccatcgcatcccctgtgacttgcacgtatacgcccagatggcctgaagttactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccatccctatctccctttgctgactctcttttcggactcagcccacctgcacccaggtgaaataaacaaccatgttgctcacacaaagcctgtttggtggtctcttcacacggacacgtatgaaa

SEQ ID NO: 27 - DNA, 7457 bp, Homo sapiens
gtcaggcctctgagcccaagctaagccatcatatcccctgtgacctgcacgtacacatccagatggccagttcctgcctcaactgatgacattccaccacaaaacaggtgaaaatggcctgttcctgccttaactgatgacattatcttgtgaaattccttctcctggctcatcctggctcaaaagctcccctactgagctccttgtgaccccactcctgcctgccagagaacaatccccctttttcctttacctacccaaatcctataaaacggccccacccgtatctcccttcaatgattctcttttcggactcagcctgcctgcacccaggtgaaataaacagccttgctgctcacacaaagcctttttggtggtctcttcacaccgaagcgcatgaaagttggtgctgtgactcggatagggggacctcccttgggagatcaatcccctgtcctcctgctctttgctccatgaaaaagatccacctacgacctcgggtcctcagacccaccagcccaaggaacatctcaccaattttaaatcgggtaagcggcctcttcttactctcttctccaacctctctcactatccctcaaccactttctcctttcaatcttgatgctacccttcaatctctcctttctcttaatttcctttcattttctagtagagacaaaggagacacgttttatccgtggacccaaaactctggcgccagtcacggactcaggaaggcagccttcccttggtgtttaatcattgcagggacgcctctgattattcacctatgtttcagagatgtctgaccacccaaggacgcctgccttggtccttcacccttagtggcaagtactgcttttctggggggcaagaaccccccaaccccttctctccatgtctctaccccttttccacttttctggagggcaagaacctccaaccccttctccttcacccttagtggcaagtaccgcttttctagggggcaaaaaccccccaaccccttctctccatgtctctaccccttctctgattttctgggggcaagaacccctggatccataatttccacgccccgacctcttatctctgcaccccgatcccttatttctacgcctcgacctcttatctctgtgcccaacccctttcctgcttttctggagggtaagaacccccgaaccccttccctccgtgtctctactctctcttttctctgggcttgcctccttcgctatgggcaaccttccaccctccattcctcctccttctcccttagcctgtgttcttaagaacttaaaacctcttcaactcacacctgacctaaaacctaaatgccgaattttcttctgcaatgccgcttgaccccaatacaaactcgacagtggttccaaatagccagaaaatggcactttcaatttttccatcctacgagatctaaataattcttgtcataaaataggcaaacggtctgagatgcctgacgtccaggcattcttttacacatcggtccctccctagtctctgttcccaatgcaacttatcccaaatcttccttctttccctcccacctgtcccctcagtcccaaccccaagcatcgctgagtctttctaatcttccttttctacagacccatctgacttctcccctcctcgccaggccgagctaagtcccaattcttcctcagcctctgctcctccaccctacaatccttttatcacctcccctcctgaaacctggtccggcttacagtttccttccgtgactatccctcccccacctgcccagcaatttcctcttaaaaaggtggctggagctagaggcatagtcaaggttaatgctcctttttctttatcccaaatcagatagcgtttaggctctttttcatcaaatataaaaacccagcccagttcatggatcgtttggcagcaaccctgagatgctttacagccctaggccctaaaaggtcaaaaggccgtcttattcttaatatatattttattacccaatctgctcccgacattaaataaaactccaaaaattaaattccggccctcaaatcccacaacaggacttaattaacctcaccttcaaggtgtacaataatagagtagaggcagccaagtagcaatgtatttctgagttgcaattccttacctccactgtgagacaaaccccagccacatctccagcacacaagaactccaaatgcccaaaccgcagctgcaaggggttcctccagaacctccaccctcaagagcttgctataagtgtgagaaatctggccaattggccaaggaatgcccacagcccgggattcctcctaagccgcgtcccatctgtgcaggaacccactgaaaatcagactgttcaactcacctggcagccgctcccagaacccctggaactctggcccaaggctctctgactgactccttcccagatcttctcagcttagcagctgaagactgacactgcccgattgcctcggaagcctacaggaccatcacagacgctctaggtaactctcacagtggaaggtaagtctgtccccttctaaatcaataccgaggctacccactccatattaccttcttttcaagggcctgtttcccttgcctccataactgttgtgggtattgacggccaggcttctaaacctcttaaaaactccccaactctggtgccaacttagaagacactctttttgcactcttttttaattatccccacctgcccagttcccttattaggccgagacactttaactaaattatctgcttccctgactactcctgggctacagccacacctcattgccaccttttcccccagttcaaagcctccttcacatcctccccttgtatctccccaccttaacccacaagtatatgaccctctactccctccttagcgaccatcatgcaccccttaccatcccattaaaacctaatcacccttaccctgctcaatgccaatatcccatcccacagcatgctttaaaaggattaaagcctgttaccactcgtgtgctacagcatggccttttaaagcctgtaaactccccttacaattccatttcacctgtcctaaaaccagacaagccttacaggttagttcaggatctgcgccttatcaaccaaactgttttgcctatccaccccgtggtgccaaacgcatatactctcctatcctcaatacctctctctacaacccattattctgttctggatttcagacatgctttctttactattcctttgcacccttcatcccagcctctcttcgctttcacttggactgaccctgacacccattaggctcagcagattacctgagctgtactgccgcaaggcttcacagacagccccctttacttcagtcaagcccaaatttcttcctcatcagtttcctatctcagcataattctcataaaaacacacatgctctccctgctgatcatgtccgagtaatctcccaaacctcaatcccttataaaacaacaactcctttccttcctaggcatggttagcgcagtcagaattctttcacaagagccgggaccgcaccctgtagcctttctgtccaaacaactttgaccttactgttttagcctagccctcatgtctgtgtgcagtggctgccgctgctttaataattttagaggccctaaaaatcacaaactgtgctcaactcactctacatttctcataacttccaaaatctcttctcttcctcatacctgacacgtatactttctgctccccggctccttcagctgtactcactctttgttgagtctcccacaattaccattgttcctggcacggacttcaatctggtctcccacattattctggataccacacctgaccctcatgattgtatctctctgatccacctgacattcacctcatttccccatatttccttctttcctttttctcaccctgatcacatttagtttattggtggcagttccaccaggcctaatcgccactcaccagcaaaggcaggctatgctatagtatcttccacatctatcattgaggctaccgctttgcccccctccactacctctcagcaagccaaattagttgccttaactcaagtcctcactcttgaaaaaggactacgcgtcaatatttacactgactctaaatatgcctttcatattctgcaccatcatgctgttatataggctgaaggaggtttcctcactacgcaagggtcctccatcattaatgcctctttaataaaaactctgctcaaggcggctttacttccaaaggaagctgcagtcattcactgcaaaggccatcaaaaggcgtcagatcccattgctctaggcaacgattatgctgataaggtggctagacaagcagctagatttccaacttctgtccttcacggccagttttcctccttcgtatcagtcactcccacctactcccccgctgaaacttccacctatcaatctcttttccacacaaggcaaatggttcttagaccaaggaaaatatctccttccagcctcacaggcccgttctattctggtgtcatttcataacctctcatgtaggttacaagccgctagcctgtctcttagaacctctcatttcctttccatcctggaaatctatcctcaaggaaattacttctcagtgttccatctgctattctactacccctcagggattgttcaggcctcctccctttcctacacatcaagctcagggatttgtccctgcccaggactagcaaattgactttactcacatgccctgagtcggaaaactaaaatacctcttagtctaggtagacactttcactgggtgggtagaggcctttcccacagggtctgagaaggccatcgctgtcatttcttcccttctgtcagacataattcctcggtttggccttcccacctctatacagtccgatagcagactggcctttattagtcaaatcagccaagcattttttcaggctcttggtattcagtgaaacctttatatcccttacggtcctcagtcttcaggaaaggtagaacggactaatagtcttttaaaaacacacctcaccaagctcagccaccaacttaaaaaggactggacaatacttttaccactttgccttctcagaattcaggcctgtcctcggaatgctacaaggtacagcccatttgagctcctgtatagacgctcctttttatttggccccagtctcattccaggcaccaggccaacttagactgtgccccaaaaaacttgtcatccctactatcttctgtctagtcatacacctattcaccgttttcaactactcatacatgccctgctcttgtttacactgccagtttacactgttcctccaagccatcacagctgatatcccctggtgctatccgcaaactgccactcttaactcttaaagtaaataaataatctttgctggcaggactatgctgaatctccttcgcactctctaattaaatgtcctaggtcctcccaattcttagacctttaatacctggttttctccttctcttattccatttttcaattcatacaaaaccgtatccaggccatcaccaataattctaaatgacaaatgtttcttctaacaaccccacaatatcaccccttaccacaaaatcttccttcagcttaatctctcccactctaggttcccacgccacctctaatcccgctggaagtagccctgagaaacatcgcccattatctctccataccacccctaaaaattttcactgtcccaacactttaccacaatttcattttatttttcttattaatataagaagtcaggaatgtcaggcctctgagcccaagctaagccatcatatcccctgtgacctgcaggtacacatccagatggccagttcctgccttaactgatgacattccaccacaaaacaagtgaaaatggcctgttcctgccttaactgatgacattccaccacaaaacaagtgaaaatggcctgttcctgccttaactgatgacattatctggtgaaattccgtctcctggctcatcctggctcaaaagctcccctactgaccaccttgtgacccccacccctgcctgccagagaataacccccctttttcctttacctacccaaatcctataaaacagccccacccctatctcccctcactgactctctttttggactcagcccacctgcacccaggtgaaataaacagccttgctgctcacacaaagcctgttgggtggtctcttcacacggacgtgcatgaaaactttgaagcaggcattttgctgtattatctcaataacatttttataacatgttgaggtagatcttacgttcattttacaaatgagaatactaagatgtggagagcttaaccaatttaagcctgaagttacaatttaatagcaggaaggtggacaaacgttttttccgttctccaattcctactgcctcctaaacatgttttacagacatgggcctcttaacaatgggacatgccctgagaaatgcatcactaggcaatttctttgttatgtgaacattacagtgtacctacacaaacttagaaggtatagcttactacatacctaggctatatggtagagcctattcctactaggctacaaatttggaaacatgtcattctactgaatactgccggcaattacaacgcaatggtagttgtgtatttaaacgtgtctacacatagaaaagctacaataaaaataacagtattataatcttacgggaccatcatcatataagcagcgcattcctgactgaaatgttggttaggcagtacatcactgtatttctttcattcttagaaaatgaagtgaaggggaatataatttattttcatatacctacctcttctcaacaagttccttatattttttggccataggggaagattctaatattcacatctgaatatcaattacctttaagcaaaatatagtgtcttcataacccagaacttgaaaaatcacaaaacttgttttcctggtacattgtgtcaggcctctgagcccaagctaagccatcatgtcccctgtgacccacatgtacacatccagatggctggttctttccttaactgacgacattccaccacacaacaagtgaaaaatggcctgttcctgccttaactgatgacattatcttgtgaaattccttctcctggctcatcctggctcaaaagctcccctgctgagcacctcgtgacccccccactcctgcctgccagagaacaacccccctttgactgtaattttcctttacctacccaaaacttataaaacggccccacccctatctcccttcactgactcttttcggactcagcccgcctgcacccaggtgaaataaacagccttgttgctcacaaaaagcctgtttggtggtctcttcacacggacacgactgaaa

SEQ ID NO: 28 - DNA, 4093 bp, Homo sapiens
tgactctcttcggactcagcccgcctgcacccaggtgaaataaacagccatgttgctcacacaaagcctgtttggtggtctcttcacacggacgcgtatgaaatttggtgccgtgactcggatcgggggacctcccttgggagatctatcccccgtcctcctgctctttgctccatgagaaagatccacctacgacctcaggtcctcagaccaaccagcccaggaaacatctcaccaatttcaaatccggtaagcggcctctttttactctcttctccaacctccctcactatccctcaaccccttctccttcaccctcagcggcaagtcccgctttcctgggacaggggcaagtacccctcaaccccttctccttcaccctcagcggcaagtcctgctttcctggggcaggggcaagtacccctcaaccccttctccttcaccctcagcagcaagtcccgctttcctagggggcaagaaccccccaatcacttatttctgcaccccaacctcttatctctgcgccccaatcccttatttccgcaccctgacctcttatttccgtgccccaaccccttctctgcttttctggagggcaagaaccccccaccccttctccgtgtctctactcttttctctgggcttgcctccttcactatgggtaagcttccaccttccattcctccctcttctcccttagcctgtgttctcaaaaacctaaaacctcttcaactaacacctgacctaaaacctaaatgccttattttcttctacaatgctgcttgaccccaatacaaattcgacagtagttccaaatagccggaaaacggcactttcaatttttccatcctacaagatctaaataattattgtcgtaaaatgggcaaatggtctgaggtgcctgacgtccaggcattcttttacacatcagtcccttcctagtctctgtgcccagtgcaactcgtcccaaatcttccttctttccctcccgcctgtcccctcagtcccaaccccaagcgtcgctgagtctttctaatcttccttttctacagacccatctgacctctcccctcctcaccagcccaagctaggtcccaattcttcctcagcctccactcctccaccctataatccttctatcacctcccctcctcacacctggtctggcttacagtttcgttctgtgactagccctcccccacctgcccagcaatttattcttaaaaaggtggctggagctaaaggcatagtcaaggttaatgctcctttttctttatcccaaatcagacagcgtttaggctttttcatcaaatataaaaacccagcccagttcatggctcgttcagcagcaaccctgagacgctttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagtggccaggcgttcctccagaacctcctcccacagaagcttgctacaagtgccagaaatctgaccaccaggccaaggaatgcctgcagcccaggattcctcctaagccgtgtcccatctgtgcgggaccccactggaaattggactgttcaactcacctggcagccactcccagagcccctggaactctggcccaaggctctctgactgactccttctcggcttagcagctgaagactgatgctccccgattgcctcggaagccctgtagaccatcatggacgccaagctttgggtaactctcacagtggaaggtaagtccgtccccttcttaatcaatacggaggctacccactccacattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcatcctcctcttatatccccccaccctaacccacaagtataagatacctctactccctccttggcgaccgatcatgcaccccttaccatctcattaaaacctaatcacccttaccccactcaacgccaatatcccatcccgcagcatgctttcaaaggattaaagcctgttatcacgcgcctgctacagcatggccttttaaagcctataaactctccttaccattcccccattttacctgtcctaaaaccagacaaggcttacaggttagttcaggatctgcgccttatcaaccaaattgttttgcctttccaccctgtggtgccaaacccatatgctctcctatcctcaatacctccctctactacccattattctgttctagatctcaaacatgctttctttactattcctttgcacccctcgtcccagcctctctttgctttcacttagactgaccctgacatccattaggctcagcaaattaccaaggctgtactgccgcaaagcttcacagacagcccccattacttcaatcaagcccaaatttcttcctcatctgttacctatctcggcataattctcataaaaacacacgtgctctccctgccaatagtgtccgactgatctctcaaaccccagcaccttctacaaaacaacaactcctctccttcttaggcatggttagcgtggtcggaattcttacacaagagccaggaccacatcctgtagcctttctgtccaaacaacttgaccttactgttttagcctagccctcatgtctgcgtgcagcggctactgctgctttaatacttttagaggccctcaaaatcacaaactttatcagtcctccaggcccaagttgactctttagctgcagttgtcctccaaaaccgccgaggccttgacttactgctgaaaaaggaggactctgcatattcttaaatgaggagtgttgtttttacctaaatcagtctggcctggtgtatgacaacataaaaaaactcaaggatagagcccaaaaacttgccaaccaagaaagtaattacgctgaacccccttgggcactctctaactggatgtcctgggccctcccaattcttagtcctttaatacccatttttctcctccttttattcggaccttgtatcttccgtttagcttctcaattcatccaaaaccgtatccaggtcatcaccaatcattttatacgacaaatgtttcttctaacatccccacaatatcaccccttaccacaagacctcccttcagcttaatctctcccactctaggttcccacgccgcccctaatcccacttgaagcagctctgagaaacatcgcccattctctctccataccaccccccaaaaattttcgccactccaacacttcaacactattttgttttgtcttattaatataagaaggcaggaatgtcaggcctctgagcccaggcaaggccatcgcatcccctgtgacttgcacgtatacatccagatagcctgaagtaactgaagatccacaaaagaagtaaaaacagccttaactgatgacattccaccattgtgatttgttccttccccaccctaactgatcaatgtactttgtaatctcccccacccttaagaaggtactttgtagtctcccccacccttaagaaggttctttgtaattctccccacccttgagaatgtactttgtgagatccacccctgcccctttgactgtaactttccattaccttcccaaatcctataaaacggccccacccctatctcccttcgctgactctcttttcggactcagcccacctgcacccaggtgaaataaacagctttattgctcacaaaaa

SEQ ID NO: 29 - DNA, 1293 bp, Homo sapiens
gtggggaaaagaaagagagatcagattgttactgtgtctgtgtagaaggaagtagacataggagactccattttgttctgtactaagaaaaattcttctgcctcgagctgctgttaatctgtaaccctacccccaaccctgtgctccctgaaacatgtgctgtgtcaagtcagggttagatggattaagggttgtgcagggtgtgctttgttaaacaaatgcttgaaggcagcacgcttgttaagagtcatcaccggccgggcgcggtggctcacgcctgtaatcccagcactttgggaggccgaggcgggtggatcatgaggtcaggagatcgagaccatcctggctaacaaggtgaaaccctgtctctactaaaaatacaaaaaattagccgggcgcggtggcgggtgcctgtagtcccagctactcgggaggctgaggcaggagaatggcatgaacccgggaagtggagcttgcagtgagccgagattgcgccactgcagtccgcagtccggcctgggcgacagagcgagactccgtctcaaaaaaaaaaaaaaaaaaaaaaaaaagagtcatcaccactccctaatctcaaaccactccctaatctcaagtacccagagacacaaaacactgcggaaggccacagagacctctgcctaggaaagccaggtattttccaaggtttctccccatgtgatagtctgaaatatggcctcatgggatgggaaagacctgaccgtcccccagcccaacacccgtaaagggtctgtgctgaggaggattagtaaaagaggaaggaacggctctttgcagttgaggtaagaggaaagcttctgtctcctgctcgtctctgggcaatggaatgtctcggtgtaaagtccattgtatattccatttactgagataggggaaaactgccttagggctggaggtgggacatgctggcagcaatactgctccttaaggcattgagatgtttatgtatatgcacatcaaaagcacagcacttttttctttaccttgtttatgatgcagagacatttgttcacgtgtttaccttctgaccttctctccactattatcctattacccatgcccaataatgatcaataaatactaagggaactcagaggccagtgcccacgtggatcctctgtatgctgaacgccggtcccctaggccccctttttctttctctgtactttatctctgtgtctctttcttttccaagtctcttgttccacctaacgagaaacacccacaggtgtgaaggggcaacccaccccttca

SEQ ID NO: 30 - DNA, 3900 bp, Homo sapiens
tgactctctttttggactcagcccacctgcacccaggtgaaataaacagccatgttgctcacacaaagcctgtttggtggtctcttcacacggacgcgcatgaaatttggtgttgtgactcggatcgggggacctcccttgggagatcaatcccctgtcctcctgctctttgctcggtgagaaagatccacctatgacctcaggtcctcagactgaccagcccaagaaacatctcaccaatttcaaatctggtaagtggcctctttttactctcttctccaacttccctcactatccctcaacctctttctcctttcaattttggcgctacacttcaatctctcccttctcttaatttcaattcctttcattttctggtagagacaaaagagacacattttatccgtggacccaaaactccggcgccagtcacggactgggaaggcagccttcccttggtgtttaatcattggagggacgcctctctgattatacacccacgtttcaagggtgtcagaccacgcagggacgcctgccttggtccttcacccttagcggcaagtcccgcttttctggggaaggggcaagtaccccaaccccttctctccttgtctctaccccttctctgcctttcctggggcaggggcaagtacccctcaatcccttctccttcacccttagcggcaagtcccgctttcctaggggcaagaaccccccaatcgcttatttccacaccccaacctcttatctctgtgccccaatcccttatttccgcaccctgacctcttatctctgtgccccaatcccttatttctgtgccccaaccccttctctgcttttctggagggcaagaaccccccaccccttctccgtgtctctactcttttctctgggcttgcctccttcactatgggtaggcttccaccttccattcctccttctcccttagcctgtgttctcaaaaacttaaaacctcttcaactcacacctgacctaaaacctaaatgctttattttcttctgcaatgccgcttgaccccaatacaaactcgacatagttccaaatagctggaaaacggcactttcaatttttccatcctataagatctaaataattcttgtcgtaaaatgggcaaacggtctgaggtgcctgacgtccaggcattcttttacacatctgtcccttcctagtctctgtgcccagtgcaactcgttccaaatcttccttctttccctccctcctgtcccctcagtcccaaccccaagcagtgctgagtctttctaatcttctttttctacagacccatctgacctctcccctccacaccaggccaagctaggtcccaattcttcctcagcctcagcgcctccacactgtaatctttttatcgccaccccccaccccctccaccccgcatcccacacctggtcctgcttacagtttcattctgtgactagccctcccccacctgcccagcaatttactcttaaaaaggtggctggagccaaaggcctagtcagggttaatgctcctttttctttatcctgaatcagatagcgtttaggctctttttcatcaaatataaaaatccagcccacttcatggctcattcggcagcaaccctgagacgctttacagccctagaccctaaaaggtcaaaaggccgtcttattctcaatatacattttattacccaatctgctcccaacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaatgcctgaaccgcagcggccaggcgttcctctagaacctcctcctccaggagcttgctacaagtgccagaaatctgaccaccaaggcaaggaacgcctgcagcccaggattcctcttaagccgtatcccatctgtgcgggaccccactggaaatcggactgttcaactcacctggcagccactcccagagcccctggaactctggcccaaggctctctgactgactccttctcggcttagcggctgaagactgacactgcccgatcgcctcggaagccccgtagaccatcatggacgccgagcttcaggtaactctcacagtggaaggtaagtccgtccccttcttaatcaatacggagcctacccactccacattaccttcttttcaagggcctgtttcccttgcctccataactgttgtgggtattgacagccaggcttctaaacttcttaaaactccccaactctggtgccaacttagacaacactcttttatgcactcttttttagttatctccacctgcccacttctcttattaggccgagatattttaaccaaattatctgcttccctgactattcctggactacagccgcatctcattgctgcccttcgtcccaatccaaaacctcctttgcttcctcctcttgtattcccccaccttaacccacaagtataagagacctctactccctccttggtgactgatcacgcaccccttaccatctcattaaaacctaatcacccttaccccgctcaacgccaatatcctatcccacagcacgctttaaaaggattaaagcctgttatcactcgcctgctacagcacgggcttctaaaacctataaactctccttaccattcccccattttacctgtcctaaaaccaggcaagggttacaagttagttcagaatctgcaccttatcaaccaaattgtttttcctatcccccccgtggtgccaaagccatatactctcctatcctcaatacctccctctgctacccattattctgttctggatctcaaacatgctttctttactatcctttgcaccttcatccagcctctctttgccttcacttagactgaccctgacacccattaggctcagcaaattacctgggctgtactgccgcaaggcttcacagacagcccccattacttcagtcaagcccaaatttcatcctcatctgttacctatctcggcataattctcataaaaacacacgtgctctccctgctgatcgtgtccgattaatctcccaaacctcaatcccttacaaaagaacaactcctttccttcctaggcatggttagtgcggtcagaattcttacacaagagccaggaccacaccgtgtagcctttctgtgcaaacaacttgaccttactgttttagcctagccctcatgtctgcatgcagcggctgccgctgctttaatactgttagaggccctaaaaatcacaaactatgctcaactcactctctacatttctcataacttccaaaatctattttcttcctcatacctgacgcatatactttctgctccccggctccttcagctgtactcactcttaaatcccacaattaccattgttcctggcccggacttcaatctggcctcccacattattcctgataccacacctgacccccatgactgtatctctctgatccacctgatattcaccccatttccccatatttccttctttcctgttcctcaccctgatcacgcttgcctcgtgctatccccaaactgccattcttaactcttgaagtaaataaataatctttgctggcagggctatgctgaatctccttaggcactctctaatcagatgtcctgagttgtcccaattcttagactttttatacctgtttttctccttctgttattccatttagtttttcaattcatacaaaaccatatccaggccatcaccaataattctacacaacaaatgtttcttctaacaaccccacaatatcaccccttaccacaaaatcttccttcagcttaa

SEQ ID NO: 31 - DNA, 928 bp, Homo sapiens
gtggggaaaaggaggacagatcagactgttactgtgtctatgtagaaagaaatagacataagagactccattttgttctgtactaagaaaaattcttctgccttgagatgctgttaacctgtaaccctagccccaaccctgtgctcccagaaacatgtgctgtgtcacacgtgggtttagggctatgcaggatgtgctttgttaaacagatgcttgaaggcagcatgcttgttaaaagtcatcaccactctctaatctcaagcacccagggacacaatacactgcggaaggctgcagggacctctgcctagaaaagccaggtattgtccaaagtttctccccatgtgatagcctgagataaggcctcgtgggaagggaaagaccagaccgtaccccagcccgacacccgtaaagggtctgtgctgaagaggattagtataagaggaaggcctttttgcagttaagaggaaggtatctgtctcctgctcgtccctgggcaatggaatgtctcggtgtaaaacccgatggtatgttccatccaccgagataggggaaaaccgccttagggctggaggtgacacatgctggcagcaatactgctctttaatgcaccagatatgtttatgtatgagcacatcaaggcacagcacatttcctaaccttgtttatgacacagacatttgctcacatgttttcctgctgaccctctccccactgttaccctattgtcctgccacatccccgtctccgagatggtagagataatgaccaataaatactgaaggaactcagagacccggccggcgcgggtctcctgagcccacttttctttctgtgtactttgtctctgtgtctctttcttttctcagtctctcgtcccacctgacaagaaacacccacaggtgtggaggggcaggccaccccttca

SEQ ID NO: 32 - DNA, 327 bp, Homo sapiens
tgggtcaggcacaaagtaagcccaccccaccaggaactatgttgaaaaatttcaagaaaggatttaagggagattatggtgttactctgacaccaggaaaagttagaactttatgtgaaatagactggccagcattagaggtggatttcccatcagaagtaagccttgacgggtccgttgtttcaaaggtatggcacaaggtaacctgtaagccagggcacgcaaaccagttcctgtacatagacacttggttacagctggttttagatccgcctcacagtggttgagagaacagcagcataagcagctgacagaggcaaggaaaga

SEQ ID NO: 33 - DNA, 3613 bp, Homo sapiens
gtcaggcctctgagcccaagccaagccatcgcatcccctgtgacttgcacgtatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctaagaaactcccccactgagcaccttgtgacccccgcccctgccccccagagaacaaccccctttgactgtcattttccattaccttcccaaatcctataaaactcagcctataagactcagcccgcctgcacccaggtgaaataaacagccatgttgctcacacaaagcctgtttggtggtctcttcacacggatgcgcatgaaatttggtgcaagaaccccccaccccttctccgtgtctctactcttttctctgggcttgcctccttcactatcggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttgtcgtaaaacaggcaaacggtctgaggtgcctgacgtccaggcattcttttacacatcagtcccttcctagtctccttgcccagtgcaactcgtcccaaatcttcctttccctctggcctgtcccctcagtaccaaccccaagcgtcgctgagtctttctaatcttccttttctacagacccatctgacctctcccttcctccccaggctgctcctcgccaggccgagctaggtcccaattcttcctcagcctccgttcctccaccctataatctttttatcacctcccctcctcacacctggtccggcttacagtttcgttccatgactagccctcccccacctgcccagcaatttactcttaaaaagccaaaggcatagtcaaggttaatgctcctttttctttatcccaaatcagatagcatttaggctttttcatcaaatataaaaatccagcccagttcatggctcgtttagcagcaatcctgagacactttacagacctagaccctaaaaggtcaaaaggccgtcttattctcaatatacattttattacccaatctgctcccgacattaaataaaactccaaaaattggaatctggccctcaaaccccacaacaggacttaattaacctcaccttcaaggtgtacaataacagaaaaaagttgcaattccttgcctccattgtgagacaaaccccagccacatctccagcacacaagaacttccaaacgcctgaaccgcagcagccaggcgttcctccagaacctcctcccccaggagcttgctacacgtgccggaaatctggccaccaagccaaggaatgcccgcagcccaggattcctcctaagccgtgtcccatctgtgcgggaccccactgaaaatcggactgttcaactcacctggcagccactcccagagcccctggaactctggcccaaggctctctgactgactccttcccagatcttctcggcttagtggctgaagactgacactgcccgatcacctcggaagccccctagaccatcacggacgccgagcttcgggtaactctcacagtgggaagtaagcccatccccttcttaatcaatacggaggctacccattccatattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacaatttaactaaattatctgcttccctgactattcctggactacagctatatctcattgccgcccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccgatatcccatcccgcagcacgctttaaaaggattaaagcctgttatcactcgcctgctacagcatgggcttttaaagcctataaactctccttacaattcccccattttacctgtcctaaaaccagacaagccttacaagttagttcaggatctgcgccttatcaaccaaattgttttgactatccaccccgtggtgccaaacccatatactctcctatcctcaatacctgcctctataacccattattctgttccagatctcaaatatgctttctttactattcctttgcacccttaatcccagcctctcttcactttcacttggactgaccctgacgcccatcaagctcagcaaattacctagtctgtactgctgcaaagcttcacagacagcccccattacttcagtcaagcccaaatttcatcctcatctgttagtcatactcctattcaccgttctcaactactcatacatgccctgctcttgtttacactgccggtttacactgtttctccaagccatcacagctgatatctcccagtgctatccccaaactgccactctaaactcttgaagtaaataaataatctttgctggcaggactatgctgaatctccttaggcactctctaattagatgccctaggtcctcccaattcttagtccttttatacctgtttttctcctactcttattccatttagtttttcaattcatacaaaaccatatccaggccatcaccaatcattctatacaacaaatgtttcttcttacatccccacaatatcaccccttaccacaagatctcccttcagcttaatctctcccactctaggttcccacaccgcccctaatcccgcttgaaacagccctgagaaacatcgcccattctctctccataccaccccccaaaatttttcgccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaaatgaaaaggccctgccccgccttaactgatgacactccaccattgtgatttgttcctgccccaccttaactgagtgattaaccctgtgaatttccttctcctggctcagaagctcccctactgagcatcttgtgacccccgcccctgccccccagagaacaaccccctttgactgtaattttccattaccttcccaaatcctataaaacggccccatccctatctcccttcgctgactctcttttcggactcagcccgcctgcacccaggtgaaataaacagccatgttgctcacacagagcctatttggtggtctcttcacacggacgtgcatgaaa

SEQ ID NO: 34 - DNA, 290 bp, Homo sapiens
gacttggatcggggggcctcccttgggagatcaatcccccgtcctcctgctttttgctccttgagaaagatccacctaggacctcaggtcctcagaccgaccagcccaagatacatctcaccaatttcaaatccgccactcccagagcccctggaactctggcccaaggctctctgactccttcccagatcttctcggcttagcggctgaagactgacactgcccgatcgcctcggaagccctctaccccatcacggacgccgagctttcggtaactcttacggtggaag

SEQ ID NO: 35 - DNA, 3653 bp, Homo sapiens
gtcaggcctctgagcccaagccaagccatcgcatcccctgtgacttgcacgtgtacgcccagatggcctgaaataactgaagaatcacaaaagaagtgaatatgccctgccccaccttaactgatgacattccacaacaaaagaagtgtaaatggctggtccttgccttaactgatgacattaccttgtgaaagtccttttcctggctcatcctggctcaaaaagcacccccactgaacaccttgtgacccccattcctgcccgccagagaacaaaccctctttgactgtaattttcctttacctacccaaatcttataaaacggccccacccttatctcccttcactgactctcttttcggactcagcccgcctgcaaccaggtgaaataaacagccatgctgctcacacaaagcctgtttggtgctctcttcacacagatgcgcatgaaatttggtgccgtgactcagatcaggggacctcccttgggagatcaatcccctgtactcctgttctttgctccgtgagaaagatccacctatgacctcaggtcctcagacctaccagcccaaggaacatctcaccaattttaaatcaggtaagcggcctcttcttactctcttctccaacctctctcactgtccctcaaccactttctcctttccaatcttcaatctctcccttctcttaatttcaattcctttcattttctaggagagacaaaggagatgcattttattcgtggacccaaaactccggtgccagtcacggactgggaaggcagccttctcttggtgtttaatcattgcagggacacctctctgattatacacccacatttcaagggtgtcagaccacgcagggacacctgccttggtccttcacccttagcggcaagtcccgcttttctgaggaagggacaagtaccccaaccccttctctccttgtctctaccccttctctgcttttctgggagaggggcaagtacccctcaaccctttctccttcacccttagcggcaagtcccgcttttctacggggcaagaacccccaatcccttatttctgcgccacaacctcttatctctgtgccccaatcccttatttccataccccgacctcttatctctgcgccccaatcccttatttccatacgccgacctcttatctctgtgccccaatcccttatttctgcgccccaacctcttatatctctgtgccccaatcccttatttctgtgccctgacctcttatctctgtgccccaaccccttttcccacttttctgggaggtaagaacccccgaaccccttccctccatttctctactctctctcttctctaggcttgcttccttcactataggcaactttccaccctccattcctccttctactcccttggcctgtgttctcaaaaacttaaaacctcttcaactcacacctgacctaaaacctaaatgccttattttcttctgcaatgctgcttgtccccaataccaactcgacagtagttccaaatagccagaaaatggcactttgaatttttccatcctgcaaaatctaaataattcttgtcgtaaaataggcaaacggtctgaggtgcctgacgtctaggcattcttttacacatcagtcccttcctagtctctgtgcccagtgcaactcgtcccaaatcttccttctttccctcccacctgtcccctcagtaccaaccccaagcgtcgctgagtctttctaatcttccttttctgcagacccatctgacctctcccttcctccccaggctgctcctcgccaggccgagctaggtcccaattcttcctcagcctctgctcctccaccctataatctttttatcacctcccctcctcacacctggtccggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacttgtttggcagcaaccctgagacgctttacagccctagaccctaaaaggtcaaaaggccatcttattctcaaaatacattttattacccaatctgctcccgacattaagtaaaactccaaaaattggaatctggccctcaaaccccaaaacaggacttaattaacctcaccttcaaggtgtacaataacagaaaaaagttgcaattccttgcatccactgtgagacaaaccccagccacatctccagcacacaagaacttccaaacacctgaaccgcagcagccaggcattcctgcagaacctcctcccccaggagcttgctacaagtgccagaaatctggccactgggccaaggaatgcctgcagcccaggattcctcctaagctgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaccatcacggatgcggagcttcaggtaactctcacagtggaaggtaagcccgtccccttcttaatcaatacggaggctacccactccacattaccttcttttcaagggcctgtttcccttgcctccataactgttgtgggtattgatggccaagcttctaaacctcttaaaactccccaactctggtgccaacttagacaatactcttttaagcactcctttttagttatccccacctgcccagttcccttattaggctgagacactttaactaaattatctgtttccctgactattcctggactacagctatatctcattgccacccttcttcccaatccaaagcctcctttgcgtcctcctcttgtatcccccaaccttaacccacaagtataagatacctctactccctccttggcgaccgatcatgcaccccttaccatctcattaaaacttaatcacccttaccccactcaatgccaatatctcatcccacagcacgctttaaaaagattaaaagcctgttatcactcgcctgctactgcatggccttttaaagcctataaactctccttacaattcccccattttacctgtcctaaaaccagacaagccttacaagttagttcaggatctgcgccttatcaaccaaattgttttgcctatccaccctgtggtgccaaacccatatactgtcctcaatacgtgcctctacaacccattattctgttctaaatctcaaacatgcttttttcactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcataattcccataaaaacacacgtgctctccctgccaatcatgtctgactgatctctcaaaccccagcacctcctacaaaacaacaactcctttccttcctaggcgtggttag

SEQ ID NO: 36 - DNA, 6271 bp, Homo sapiens
gtcaggcctctgagcccaagccaagccatcacatcccctgtgtcttgcacctatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgaccccgactcctgcccgccagagaacaaaccccctttgactgtaattttccgttacctacccaaatcctataaaacagccccacccttatctcccttcactgactctcttttcggactcagcccgcctgcacccaggtgaaataaacagccttgttgctcacacaaagcctgtttggtggtctcttcacacggacgcgcatgaaatttggtcccagtcaggcctctgagcccaagccaagccatcgcatgccctgtgacttgcacatgtatgcccagatggcctgaagtaactgaagaatcacaaaagaagtgaatgtgccctgccccgccttaactgatgacattccaccacaaaagaagtgaaaaaggccggtccttgccttaagtgatgacattaccttgtgaaagtccttttcctggctcatcctggctcaaaaagcacccccactgagcaccttgcgacccccactcctgcctgccagagaacaaaccccctttgactgtaattttcctttacctacccaaatcctataaaacagccccacccttatctcccttcactgactctcttttcggactcagcccgcctgcacccaggtgaaataaacagccttgttgctcacacaaagcctgtttggtggtctcttcacacggacatgcattaaatttggtgccgtgactcagatcaggggacctcccttgggaaatcaatcccctgtcctcctgctctttgctccgtgagaaagatccacctacgacctcaggtcctcagaccaaccagcccaagaaacatctcaccaatttcaaatccagtaagccgcctctttttactctcttctccaacctccctcactatccctcagcctctttctcctttcaatcttggtgccacacttcaatctctcccttcttttaatttcaattcctttcattttctggtagagacaaaggagacatgttttatccctggacccaaaactctggcgccggtcacggactagggaaggcagctttcccttggtgtttaatcatttcagggacacctctctgattatttacccaggtttcagaggtgtcagaccacgcagggatgcctgccttggtccttcacccttagtggcaagtcctgcttttctggggaaggggcaagtaccccaaccccttctctccgtgtctctaccccttctctgcctttctggggggcaagaaacccccaaccctttctccttcaccctgagtggcaagtcccacttttctagaggaggggaaagtaccccaacctcatatctctgcacctcaatcccttatttccacaccccaacctattatctctgtgccccaatcccttatttccatgccccaacctcttatctctgcaccacaatcccttatttccatgccccgacatcttatgtctccacgccctgacctcgtatctctgcaccccgacccctttcctgcttttctggagggtaagaacccctgaaccgcttccctccgtgtctctactctcccttttctttaaacttgcctccttcactataggcaaccttccaccctccattcctccttcttctctcttagcctgtgttctcaaaaacttaaaacctcttcaactcacacctgacctaaaacctaaatgccttattttcttctgcaatgccgcttgaccccaatacaaactcaacagtagttccaaatagccggaaaacagcactttcaatttttccatcctgcaagatctaaataattcttgtcgtaaaatgggcaaacggtctgaggtgcctgacgtccaggcattcttttacacatcggtccctccccagtctctgtgcccaatgcaactcatcccaaatcttccttctttccctcccacctgtcccctcagtcccaaccccaagcatcactgagtctttctaatcttccttttctacagacccatctgacctctcccctcctccccaggctgctcctcaccaggccgagctaggtcccaagtcttcctcagcctccgctcctccaccctataatccttttatcacctcctctcctcacacccagtccggtccggcttacagtttcattccgtgactagccctcccccacctgccagcaatttactcttaaaaaggtggctggagctaaaggcatagtcaaggttattgctcctttttctttatcccaaatcagatagcgtttaggctctttatcaatataaaaatccagcccagttcataacttgtttggcagcaaccctgagacactttacagccctagaccctaaaaggtcaaaaggccgtcttattctcaaaatacattttattacccaatctgctcctgacattaaataaaactccaaaaattaaattccagccctcaaaccccacaacaggatttaattaacctcgccttcaaggtgtacaataatagaaaaaagttgcaattccttgcctccactgtgagacaaaccccaaccacatctctagcacacaagaacttccaaatgcctgaaccgcagcggccaggcgttcctccagtaccgcctcccccaggagcttgctacaagtgccagaaatctggccaccaggccaaggaatgcctgcagcccaggattcctcctaagccgcgtcccatctgtgcgagaccccactggaaatcggactgtccaactcacctggcagccactcccagagcccctggaactctggcccaaggctctctgactccttcccagatcttcttggcttagcggctgaagactgacgctgcccagtcgcctcggaagcccccctacatcatggacgctgagcttcagataactctcacagtggaaggtaagtccgttcccttcttaatcaatacggaggctacccactccacattaccttcttttcaaaggcctgtttccctcacctccataactgttgtaggtattgacggcaaggcttctaaacctcttaaaacttcccaactctggtgccaacttagacaatactcttttaagcactccttttagttatccccacctgcccagttcccttattaggcggagacactttaactaaattatctgcttccctgactattcctgggctacagccacacctcattgctgcccttcttcccaatccaaagcctcctttgtgtcctcctcttgtatccccccaccttaacccacaaatataagatacctctactccctccttggcgaccgatcatgcaccccttaccatcccattaaaacctcatcacccttaccccgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctgcgccttatcaaccaaattgttttgcctatccaccccgtgctgccaaacccatatactctcctatcctcaatacctgcctctacaacccattattctgttctagatctcaaacgtgctttctttactattcctttgcacccttaatcccagcctctcttcgctttcactttgactgaccctgacacccatcaagctcagcaaattacctgggctgtactgccgcaaagcttcacagacagcccccattacttcaatcaagcccaaatttcttcctcatctgttacctgtctcagcataattctcataaaaacacacgtgctctccctaccaatcgtgtccgactgatctctcaaaccccagcaccttctacaaaacaacaactcctttccttcctaggcctggttagcacggtcagaattcttacacaagagccaggaccacaccctgtagcctttctgtccaaacaacttgaccttactgttttagcctagccctcatgtctgcgtgcagcggctgccactgcattaatacctttagaggccctcaaaatcacaaactatgctcaactcactctctacagttctcataacttccaaaatctattttcttcctcatacctgacacatactttctttttcccggctccttcagctatactcactctttgttgagtctcccacaattaccattgttcctggcccagacttcaatctggcctcccacattattcctgataccacacctgacccccatgactgtatctctctgatccacgtgacattcaccccatttccccaaatttccttctttcctgttcctcaccctgatcacgcttgatttattgatggcggttccaccaggccttatcgccacacaccagcaaaggcaggctatgctatggtacaagccactagcccacctctcagaacctctcatttcctttccatcgtggaaatctatcctcaaagaaataacttctcagtgttccatctgctattctactactcctcaaggattattcaggccccctcccttccctacacatcaagctcaaggatttgccccaaccaggactggcaaattagctttactcaacatgccctgagtcagataactaaaatacctcttagtctaggtagatactttcactggataggtagaggcctttcctacagggtctgagaagtcctcctcagtcatttcttcccttctgtcagacatagttcctcagtttagccttcccacctcaatgcagtctgataacagaccagcctttattagtcaaatcagccaaggagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgcccccaaaaaacttgtcatccctactatcttctgtctagtcatactcctattcaccattctcagctactcatacatgccctgctcttgtttacactgccggtttacactgtttttccaagccatcacagctgatatctcctggtgctatccccaaactgccactcttaactcttgaagtaaataaataatctttactggcaggactatgctgaatctccttaggcactctctaatcagataccctaggtcctcccaattcttagacattttatacctgtttttctcctctgttattccatttagtttctcaattcatccaaaaccgtatccaggccatcaccaatcattctatacgacaaatgtttcttctaacattcccacaatatcaccccttaccacaagacctcccttcagcttaatctctcccactttaggttcacctaatcccgcttgaagcagccctgagaaacattgcccattctctctccataccaccccccaaaaattttcgccaccccaacacttcaacactattttatttttcttattaatatgagaaggcaggaatgtcaggcctctgagcccaagccaagccatcgcatcccctgtgacttgcacctatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatactggctcaaaaagcacccccactgagcaccttgcgaccccgactcctgcccgccagagaacaaaccccctttgactgtaattttcctttacctacccaaatcctataaaacagccccacccttatctcccttcgctgactctcttttcggactcagcccgcctgcacccaggtgaaataaacagccttgttgctcacacaaagcctgtttggtggtctcttcacacggacgcgcatgaaa

SEQ ID NO: 37 - DNA, 6158 bp, Homo sapiens
gtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcaggtaagcggcctcttcttactctcttctccaacctctctcactgtccctcaaccactttctccctttcactcttcaatccctcccttctcttaatttcaattcctttcattttctgggagagacaaaggagacacattttatccgtggacacaaaactccagcgccggtcacagactgggaaggcagccttcccttggtgtttaatcattgcagggacgcgtctctgattatacacccacctttcaagggtgtcagaccacgcaggaatgcctgccttggtccttcacccttagcggcaagtcccacttttctggggaaggggcaagtaccccaaccccttctctccttgtctctaccccttctctgcttttttgggagaggggcaactattcctcaaccccttctcctgcacccttagcggcaagtcccgcttttctacggggcaagaacccccaatcccttatttccacgccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttccacaccccgacctcttatctctctgccctaatcccttatttctgcaccccgacctcttatctctgtgtcccaatcccttatttctgagccccaacctcatatctctgcaccccaaccccttatttctgtgccccaaccttttatatctctgtgccccaatcccttatttctgcaccccaaccacttttcccacttttctggaagataagaacccccaaatcccttccctccgtttctctactctctcttttctctaggcttccttccttcactatgggcaaccttccgccctccattcctccttctactcccttggcctgtgttctcaaaaacttaaaacctcttcaactcacacctgacctaaaacctaaatgccttattttcttctgcaatgccgcctgaccccaatacaaactcaacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccagtgcaacttgtcccaaatcttccttctttccctcctgcctgtccccccagtaccaacaccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctggtctggcttacagtttcgttctgtgactagccctccccctcctgcccagcaatttactcttaaaaaggtggctagagctaaaggcatagtcaaggttaatgctcctttttctttatcccaaatcagatagcatttaggctctttttcatcaaatataaaaacccagcccagttcatggctcgtttggcagcaaccctgagacgctttacagccctagaccctaaaaggtcaaaaggccgtcttattctcaatatacattttattacccaatctgctcccaacattaaataaaactccaaaaactggaatttggccctcaaaccccacaacaggacttaattaacctcaccttcaaggtgtgcaataacagaaaaaaagttgcaattccttgcctccactgtgagacaaagcccagacacatctccagcacacaagaatttccaaacgcctgaaccatagcagccaggcgttcctccagaacctcctcccccaggagcttgctacaagtgccagaaatctgatcaccaggccaaggaatgcctgcagcccaggattcctcctaagccgtgtcccatctgtgtgggaccccactggaaattggactgttcaactcacctggcagccactcccagagcccctggaactctggcccaaggctctctgactgactccttcttggcttgccggctgaagaccgacgctgcctgatcacctcagaagccccgtagaccatcacggacgccgagctttaggtaactcacagtggagtgtaagtccgtccccttcttaatcaatacggaggctacccactccacattaccttcttttcaagggcctgtttcccttgcccccataactgttgtgggtattgacagccaggcttctaaaccttttaaaactcccccactctggtgccaacttagacaacacccttttatgcactcttttttagttatctccacctgcccagttcccttattaggccgagatattttaaccaaattatctgcttccctgactattcctggactacagccacatctcattgccgcccttctccccaacccaaagcctccttcgagtcttcctctcatatccccccaccttaacccgcaagtataggatatctctactccttccctggcaactgatcacaggcccattaccatcccattaaagcctaatcacccttaccccactcaatgccaatatcccatcccacagcacgctttgaaaggattaaagcctgttaacactcgcctgctacagcatggccttttaaagcctataaactctccttaccattcccccattttaagtgtcctgaaaccagacaaggtttacaagttagttcagaatctgcgccttatcaaccaaattgttttgcctatccaccccgtggtgccaaacccatatactctcctatcctcaatacctccctctactacccattattctgttctatatctcaaacatgctttctttactattcctttgcacccttcatcccagcctctctttgctttcacttatactgaccctgacacccattaggctcagcaaattacctgggctgtactgccacaaggcttcacagacagcccccattacttcaatcaagcccaaatttcttcctcatctgttacctatctcggcataattctcataaaaacacacgtgctttccctgctgattgtgtctgattaatctcccaaacctcaatcccttacaaaacaacaactcctttccttcctaggcatggttagtgtggtcagaattcttacagaagagccaggaccgcaccctgtagcctttctgtccaaacaacttgaccttgctgttttagcctagccctcatgtctgcgtgcagcggctgccgctgctttaatacttttagaggccctaaaaatcacaaactatgctcaactcactctctacatttctcataacttccaaaatatattttcttcctcatatctgacgcatatactttctgcttcccggctccttcagctgtactcactctttgttaagtcccacaattaccattgttcctggccgggacttcaatctggcctcccacattattcctgataccacacctgacccccatgactgtatctctctgatccacctgatattcaccccatttccccatatttccttcttttcctgttcctcaccctgatcacgcttgatttattgatggcagttccaccaggcctaatcgccacataccagcaaaggcaggctatgctatagtacaagccactagcctgcctcttagaacctctcatttcctttccatcgtggaaatctaccctcaaggaaataacttctcagtgttccatctgctattctactcctcagggattattcagaccccctcccttccatacacgtcaagctcgaggatttgcccccacccaggactggcaaattagctttactcaacatgcccaagtcaggaaactaaaatacctcttagtctaaataaacactttcactgaataagtaaaggcctttcctacagggtctgagaaggccaccacagtcatttcttcccttctgtcagacataattcctcagtttagccttcccacctctatacagtctgataacagacgagcctttattactcaaatcagccaattagtttttcaggctcttagggttcagtgaaaccttcatatcccttacggtcctccatcttcaagaaaagtagaacggactaaagatcttttaaagacacacctcaataagctcagccaccaacttaaaaaggactggacaatacttttaccactttcgtttctcagaattcaggcctgtcctcagaatgctacagggtacagcccatttaagctcctgtatagatgctcctttttattaggccccagtctcattcgacaccagaccaacttagactgtgccccaaaaaaacttgtcatccctactatcttttgtctagtcatactcctattcaccattctcaactactcatacatgccctgctcttgttttcactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcatcccaattcttaaaccttttatgcctgtttttctccttctgttattccatttagtttttcaattcgtacaaaaccgtatccaggccatcaccaatcattctatacgacaaatgtttcttctaacatccccacaatatcaccccttaccacaaggcctcccttcagcttaatctctcccactctaggttcccacgccacccctaatcccgcttgaagcagccctgagaaacatcgcccattctgtctccataccaccccccaaaaattttcgccgccccaacacttcaacactattttgttttatttttcttattaatataagaaggcaggaatgtcaggcctctgagcccaagccaagccatcacatcccctgtgacttgcatgtatacacccagatggcctgaagtaactgaagaatcacaaaagtgaatatgccctgccccaccttaactgatgacattccaccacaaaagaagtgtaaatggccggtccttgccttaagtgatgacattaccttgtgaaagtcctcttcctgcctcatcctggctcaaaaagcacccccactgagcaccttgcaacccccactcctgcccgccagagaacaaaccccctttgactgtaattttcctttacctacccaaatcctgtaaaacggccccacccttatttccctttgctgactctcttttcggactcagcctgcctgcacccaggtgaaataaacagccatgttgctcacacaaagcctgtttggtggtctcttcacacggacgtgcatgaaa

SEQ ID NO: 38 - DNA, 6004 bp, Homo sapiens
gtcaggcctccgagcccaagccaagccatcgcatcccctgtgacttgcacgtatatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaatggccccatccttatctcccttcgctgactctctcttcggactcagcccgcctgcacccaggtgaaataaacagccatgttgctcacacaaagcctgtttggtggtctcttcacatggacgcgcatgaaatttggtgctgtgactcggatgggggacctcccttgggagatcaatcccctgtactcctgttctttgctccgtgagaaagatccacctatgaccttaggtcttcagaccgaccagcccaagaaacatctcaccaatttcaaatctggtaagcggcctctttttaccctcttctccaacctccctcactatccctcaacctctttctcctttcaatcttggcgccacacttcaatctctcccttctcttaatttcaattcctttcattttctgatagagacaaaggagacatgttttatccatggacccaaaactccggcgccggtcacggactgggaagacagccttcccttggtgtttaatcattgcagggacgcctctctattcacccacgtttcaaaggtgtcagaccacgcatggacgcctgccttggtccttcacccttagcggcaagtcccgcttttctggggaaggggcaagtaccccaactccttctctccttgtctctaccccttctctgctttccgaggaaagggcgagtatcccaaccccttctctccttgtctctactccttctctgcttttctgggagaggggcaagtacccctcaaccccttctccttcactcttagtggcaagtcccgcttttctagaggagggacaagtgccccaacctcgtatctctgtgccccaatcccttatttccgtgccccaacctcttatatctctgcaccccaatcccttatttcagtgtcccaaccccttatttccgtgccccgaccccttatttctgtgcccctaccccttatttccgtgcccctaccccctatttctgtgcccctaccccttatttccgtgccccttccccttatttccatgccctgaccccttatttctgcgccccatcccttatttctgcatcccaacctcttatctctgtgccccgacctcttatctctgcgccccaaccccttttcccacttttctggaaggtaagaacccccgaaccccttccctctgtttttctctcttttctctaggcttgcttccttcactataggcaaccttccaccctccattcctccttctgctcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttctatcctgcaagatctaaataattcttgtcataaaataggcaaacggtctgaggtgcctgacgtccaggcattcttttacacatcagccccttcctagtctctgtgcccagtgcaacttgtcccaaatcttccttctttccctcccgcctgtcccctcagtaccaaccccaagcatcactgagtctctctaatcttccttttctacagacccatctgacctctcccttcctccccaggctgctcctcgccaggccgagctaggtcccaattcttcctcagcctccgctcctccaccctataatctttttatcacctcccctcctcacacctggtccggcttacagtttccttccgtgactagccctcccccacctgcccagcaatttactcttaaaaaggtggctggagccaaaggcatagtcaaggttaatgttccttttctttatcccaaatcagaagcatttaggctctttttcatcaaatataaaaatccagcccagttcatggctcctttggcagcaaccctgagacgctttacagccctagaccctaaaaggtcaaaaggccgtcttattctcactatacattttattacccaatctgctcctgacattaaataaaactccaaaaattggaatctggccctcaaaccccacaacaggacttaattaacctcaaccttcaaggtgtacaataacagaaaaaagttgcaattccttgccttcactgtgagacaaaccccagccacatctccagcacacaagaacttccaaacacctgaaccacagcggccaggcattcctccagaacctcctcccacaggagcttgctgcatgtgccaaaaatctggccactgggccaaggaatgcccacagcccgggattcctcctaagctgcgtcccatctgtgtaagaccccactgaaaatcggacggttcaactcacctggcagccactcccagagcccctggaactctggcccaaggctctctgactgactccttcccagatcttctcggcttagcggctgaagattgacactgcccgatcgcctcggaagccccctagaccatcacggacgctgagcttcgggtaattctcacagtggaaggtaagcctgtccccttcttaatcaatacagaggctacccactccacattaccttcttttcaagggcctgtttcccttgcctccataactgttgtgggtattgacagccaggcttctaaacctcttaaaactccccgactctggtgccaacttagacaatactcttttaagcactcctttttagttatccccacctgcccagttcccttattaggctgagacactttaactaaattatctgcttccctgactattcctggactacagctatatctcattgccacccttcttcccaatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatcccgcagcatgctttaaaaagattaaagcctcttatcactcgcctgctacagcatggccttttaaagcctataaactctccttacaattccccgattttacctgtcctaaaaccagataagccttacaagttagttcaggatctgcgccttagcaaccaaattgttttgcctatccaccctgtggtgcccaacccgtacactcttttgtcctcaataccttcctccacaactcactattccgtgcttgatcttaaagatgcttttttcactattcccctgcaccccttgtcccagcctctctttgctttcacttagactgaccctgacacccatcgagctcagcaaattacctaggctattcggccgcaaagcttcacagacagcccccattacttcaatcaagcccaaatttcttcctcatctgttacctatcttggcataattctcaaaaaaacacacgtgctctccctgccaattgtgtccaactgatctctcaaaccccagcaccttctacaaaacaacaactcctttctttcctaggcatggttagcgcggtcagaattcttacacaagagccaggaccacaccctgtagcctttctgtccaaacttgaccttactgttttagcctagacctcaggtctgtgtgcagcggctgccgctgctttaatacttttagaggccctcaaaatcacaaactatgctcaactcactctctatagttctcataacttccaaaatctattttcttcctcatacctgatgcatatactttctgctccgcagctccttcagctgtactcactctttgttgagtctcccacaattactgttgttcctggcccagacttcaatccggcctcccacattattcctgataccacacctgacccccatgactgtatctctctgatccacctgacattcaccccatttccccaagtttccttctttcctgttcctcaccctgatcacgcttgatttattgatggtggttccaccaggccgaatcgccacacaccagaaaaggcaggttatactatagtactagccactagcccgtctcttagaacctctcatttcctttccatcgtggaaatctatcctcaaagaaataacttatcagtgttccatctgctattctactactcctcagggattattcaggccccctcccttccctacacatcaagctcaaggatttgcccccacccaggactggcaaattagctttactcaacatgccctgagtcagataactaaaatacctcttagtctagatagatactttcactggataggtagaggcctttcctacagggtctgagaaggccactgcagtcatttcttccattctgtcagacataattcctcagtttagccttcccacctcaatacagtctgataacagacgagcctttattagtcaaatcagctaagcagtttttcaggctcttagtattcagtgaaacctttatatcccttacggtcctccatcttcaagaaaagtagaatggactaaaggtcttttaaaaacacacctcaccaagctcagccaccaacttaaaaaggactggacaatacctttaccactttcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctactatcttctgtctagtcatactcctattcaccgttctcaactactcatacatgccctgctcttgtttacactgccggtttacactgtttctccaagccatcacagctaatatctcctggtgctatccccaaactgccactcttaactcttgaagtaaataaataatctttgctggcaggaatatgctgaatctccttaggcactctctaatcagatatcctgagtcgtcccaattcttagaccttttatacctgtttttctccttctgttattccatttagtttctcaattcatcccaaaccgtatctaggccatcaccaatcattctataagacaaatgtttcttctaacatccccacaatatcaccccttaccacaagacctcccttcagcttaatctctcccactctaggttcccatgccgcccctaatcccgcttgaagcagccctgagaaacatctcccattctctctccataccaccccccaaaattttcgccgccccaacacttcaacactattttgttctatttttcttattaatataagaaggcaggaatgtcaggcctctgagcccaagccaagccatcccctgtgactggcacgtatatgtccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggttcatcctggctcaaaaagcacccccactgagcaccttgcgacccccactcctgcccgccagagaacaaaccccctttgactgtaattttcctttacctacccaaatcctataaaatggccccacccttatctcccttcgctgactctctttttggactcagcccgcctgcacccagatgaaataaacagccatgttgctcacacaaagcctgtttggtggtcccttcacacggacgcgcatgaaa

SEQ ID NO: 39 - DNA, 3505 bp, Homo sapiens
gtcaggcctctgagcccaagccaagccatcacatcccctgtgacttgcacgtatacacccagatggcctgaagtaactgaagaatcacaaaagaagtgaatacgccctgccccaccttaactgatgacattccaccacaaaagaagtgtaaatggctggtccttgccttaactgatgatattaccttgtgaaaatccttttcctgcctcatcctggctcaaaaagcacccccactgaacaccttgcgacccccactcctgcccaccagagaacaaaccccctttgactgtaattttcctttacctacccaaatcctgtaaaacagccccacccttatctcccttccctgactctcttttcggactcagccccccagcacccaggtgaaataaacagccatgttgctcacacaaaacctgtttggtggtctcttcacgcagacacacatgaaatttggtgccgttttttgttgctcacacaaagcctgtttggtggtctcttcacaggggcgcgcatgaaatttggtgccgaaacatctggttgtcaaaataacctcatgtgctggctactacagatatttctaacctcattttacaaacttaaggaacttagccccagagatgttgatctgtctctgttttttttttttcattcactgaacaaatacttactgaaaacctactaagtgccgtatgttgccctaagaattgtagggtgacaaaccatcccagcttgcccagaactagggagattcctgggatgcagatttttcgtgctaaaacgggactgtcctgagcaaactgggatggttgatcagcttaactcaatctggccaccctaacagcacatcacagttcaagtcacaaaataaaccataccagatggagagctctgtctctctctctctttcattatttttgcctcacttgggacttttatttctagaccctactcccagcattagactaaaagttctccttaatgttgccagtgatcacccaagcacgaaaaatactttgctgcccacttatctgcaaaatttgacattctgaccacctgatactctctttggcctttactctttcccttgcttttctctctctttcataatgcccaacatcttcccatctaaactttcatcattaagtgcatggcacccaaatgtatacccatagctgcaatgtgatggctttgacatgtggatgtgtatgactaaaaggtatctccttaactcctggctatcccaagtattcaaataaactaaatctcaacaaaaatgttgttttctccacccccaattcttcctcagcctctgctccttcaccttataatccttctaccacctcccctcctcacacccggtctggcttacagtttagttccgcgactagctcttccccacctgcccaacaatttcctcttagagaggtggctggagctgaaggcacagtcagggcacatgtacctttttctctatcagacctctctcagatcagtcaatgtttaggctctttctcatcagaccccactaaatatatacaggaattccaatatctaactctgtcctacaacttaacctggagtgacttaaatgtcatcctgacgtctaccctctcctcagatgcacgggaaagaattttttctctggcccaatctcatgctgataactgctggcttcatgagccagacctccaggaaggcattagagcagttccccgagaggatccccaatggaactaccaggcaaattccccaggtatagctaggcgatattacatgttttcctgcctagtcgtagggcttaaaaaagcagcttacaaagctgttaattgtgacaaacttaaagaaactacccaaggtaaagatgaaaacccagcccggttcatggcccgcttagcggcaacccttagacgctttaccgccctagacccagaggggccagaaggccgccttattcttaacatgcattttatcacccaatccactcctgacattaggaaaaaacttcaaaaactagaatctggccctcaaaccccacaacaggaattaatcaacctcaccttcaaggtgtacaataatagagaggaagcagccagacggcaacgcgtttctgagttacaattacttgcctctgctgtgagagaaaacccagccacacctcctgcatatgagaacttcaaaatgcctaagccgcagcagtcaagcattcctacaagacttcctccaacaggatcttgcttcaagtgccagaaatctggccactgggccaaggaatgcccgtagcctgggattcctcccaagccatgtcccatctgtgcagggacccactggaaatcagactgcccagctcacctggcagccattcctagagcccctaaagctctagcccaaggctctctgattccttcccagatcttcttggcttagcagctgaagactgacactgcccgattgcctcggaagcaccctacaccatcaaggacaccgagcttcaggtaactctcacagtggaaggtaagcccatccccttcttaatatggaggctacccactccacattaccttcttttcaagggcctgtttcccttgcctccataactgttgtgggtattgatggccaggcttctaaacctcttaaaactccccaactctggtgccaacttagacaataatcttttaagcactcctttttagttatccccatctgcccagttcccttattagtctgagacactttaactaaattatctgcttccctgactattcctggactacagctgtatctcattgctgcccttcttcccaatccagtctcctttgcgtcctcctcttctatccccccaccttaacccacaagtataagatacctctactccctccttggcgaccgatcatgcaccccttaccatctcattaatacctaatcacccttacctcactcaatgccaatatcccatcccccagcacgctttaaaaagattaaagtctgttatcacttgcctgctacagcatggccttttaaaccctataaactctccttacaattcccccattttacctgtcctaaaaccagacaagccttacaagttagttcaggatctgcaccttatcaaccaaattgttttgcctctccaccccgtggtgcccaacccgtacactcttttgtcctcaataccttcctccacaactcactattccatgcttgatcttaaagatgattttttcactattcccctgcacccctcatcccagcctctctttgctttcacttagactgaccctgagacccattaggctcagcaaattacctaggctgtactgccgcaaggcttcacagacagcccccattacttcagtcaagcccaaattttatcctcacctgttacctatctcggcataattctcataaaaacatacgtgctttccctgctgatcatgtccgattaatctcccaaacctcaatcccttacaaaacaacaactcctttccttcctaggcatagttag

SEQ ID NO: 40 - DNA, 7232 bp, Homo sapiens
gacaggcctctgagcccaagccaagccatcacatcccctgtgacttgcatgtatatgcccagatggcctgaagtaactgaagaatcacaaaagaagtgaaaaggccctgccctgccttaactgatgacattccaccattgtgatttgttcctgccccaccttaactgagtgactaaccctgtgaatttccttctcctggctcagaagctcccccactgagcaccttgtgacccccgcccctgcccaccagaaaacaaccccctttgactgtaattttccattaccttcccaaaccctataaaatggccccacccctatctcccttcgctgactctcttttcggactcagcccacctgcacccaggtgaaataaacagccttgttgctcacacaaagcctgtttggtggtctcttcacacggacgcgcatgaaatttggtgccatgactcggatcgggggacctcccttgggagatcaatcccctgtcctcctgctctttgctccatgaaaaagatccacctatgacctcgagtcctcagacccaccagcctaaggaacatctcaccaattttaaattgggtaagcagcctcttcttactctcttctccaagctctctcactgtccctcaaccactttctcctttccactcttcaatctctcccttctcttaatttcaattcctttcattttctgggagagacaaaggagacatatttaatccatggacccaaaactccggcgctggtcatagactgggaagacagtcttcccttggtgtttaatcattgcagggatgcctctctgattaaacacacaggtttcaagggtgtcagaccacacagggacgcctgccttggtccttcacccttagcggcaagtcccgtttttctggggaaggggcaagtacctcaaccccttctctccttgtctctactccttctctgcttttctgggagaggggcaagtacccctcaaccccctctccttcacccttagcggcaagtcccacttttctatggggcaagaacccccaatcccttatttccatgccccaacctcttatctctgcaccacaatcccttatttctgtgccccaacctcttatctctgtgccccaatccctaatttctgcaccccgacctcttatctctgttccccatcccttatttctgcaccccaacctcgtatctctgtgccccaatcccttacttctgcaccccaacctcttatatctctgcactacaatcccttatttccatgccccaacctcttatctctgcaccccaatcccttatttctgtgccctgaccccttatttccatgccccgaccccttatttccgtgccccaatcccttatttctgcaccccatcctcttatctctgtgccccaatcgcttatttctgtgccccaacctcgtatctctgcaccccaatcccttatttccgcacactgacctcttatctctgtgccccaatcccttatttccatgccccaaccccttctgtgcttttctggagggcaagaaccccccaccccttctctgtgtctctactcttttctctgggcttgcctccttcactatgggtaagcttccaccttccattcctccttcttctcccttagcctgtgttctcaaaaacttaaaacctgttcaactcacacctgacctaaaacctaaatgccttattttcttctgcaatgccgcttgaccccaatacaaactcgacagtagttccaaatagccagaaaacagcaatttcaatttttccatcctacaagatctgaataattcttgtaaaataggcaaatggtctgagatgcctgatgtccaggcattcttttacacatcagtcccttcctagtctctgtgcccagtgcaactcatcccaaatcttccttctttcccccctgcctgtcccctcagtcccaaccccaagcgtcactgagtctttctaatattccttttctacaaacctatctgacctctcccctcctcgccaggctgagctaggtcccaattcttccaccctataatctttttatcacctcccctcctcacaactggtctggcttacagtttcgttccgtgactagccctcccccacctgcccagcaatttactcttaaaaaggtggctggagccaaaggcatagtcagggttaatgctcctttttctttatcccaaatcagaagcgtttaggctctttttcatcaaatataaaaatccagcccagttcatggctcatttggcagcaaccctgagacactttacaaccctaaaatgtcaaaaggccgtcttattctcaatatacattttattaaccaatctgctcccgaaattaaataaaactccaaaaattggaatctggccctcaaaccccacaacaagacttaattaacctcaccttcaaggtgtgcaataacagaaaatagttgcaattccttgcctccactgtgagacaaaccccagccacatctccagcacacaagaacttccaaacgcctgaactgcagcagccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcagctcacctggcagccactcccagagcccctggaactctggcccaaggctctctgactgactccttttgggcttagcggctgaagactgacgctgcctgatcacctcggaagccccatagaccatcacagacgccgagctttggataactctcacagtggaaggtaagtccgtccccttcttaatcaatacggaggctacccactccacattaccttcttttcaaggacctgtttcccttgcctccataactgttgtgggtattgacagccaggcttctaaacctcttaaaactccccaactctggtgccaacttagacaatactcttttatgcacccttttttagttatccccacctgcccagttcccttattaggccgagatattttaaccaaattatctgcttccctgactattcctggactatagccgcatctcattgctgcccttcttcccaatccaaagcctcctttgcgtccttctcttgtattcccccaccttaacccacaagtataagatacctctactccctccttggtgaccaatcatgcgccccttaccatctcattaaaacctaatcacccttaccccactcaatgccaatatcccatcccagagcacgctttaaaaggattaaagcctgttatcactcacctgctacagcatgggcttctaaaacctataaactctccttaccattcccccattttacctgtcctaaaaccagacaagccttacaagttagttcagaatctgtgccttatcaaccaaattgttttgcctatccaacccatggtgccaaacccatatactctcctatcctcaatacctccctctactacccattattctgttctggatctcaaacatgctttctttactattcctttgcacccttcaccccagcctctctttgccttcacttagtttgaccctgacacccattaggctcagcaaattacctgggctgcactgccgcaaggcttcacagacagcccccattacttcagccaagcccaaatttcatcctcatctgttacctatcttggcataattctcataaaaacacacgtgctctccctgctgatcatgtccgattaatctcccaaacctcaatcccttacaaaacaacaactcctttccttcctaggcatggttagtgtggtcagaattcttacacaagagccaggaccacaccgtgtagcctttctgtccaaacaacttgaccttactgttttagcctagccctcatgtctgtgtgcagcagctgctgctgctttaatactgttagaggccctaaaaatcacaaactatgctcaactcactctctacatttctcataacttccaaaatctattttcttcctcatacctgacacatatactttctgctccctggctccttcagctgtactcactatttaagtcccacaattaccattgttcctggcccggacttcaatctggcctctcacattattcctgataccacacctgacccccatgactgtatctctctgatccacctgatattcaccccatttccccatatttccttctttcctgttcctcaccctgatcatgcttgatttattgatggcagttccaccaggcctaatcgccacacaccagcaaaggcaggctatgctatagtacaagccactagcccacctctcagaacctctcatttcctttccatcatggaaatctatcctcgaggaaataacttctcagtgttccatctgctattctactactacacagggattattcaggccccctcccttccctacacataaagctcgaggatttgcccccacccaggactggcaaattagctttactcaacatgtcccgagtcaggaaactaaaatacctcttagtctaaatagacactttcactgaataagtaaagacctttcctacagggtctaagaaggccaccacagtcatttcttccctactgtcagacataattcctcagtttagccttcccacctctatacagtctgataacagaccagcctttattagtcaaatcagccaagcagtttttcaggctcttagtattcagtgaaacctttatatcccttacggtactccatcttcaagaaaagtagaacggactaaaggtcttttaaaaacacacctcaccaagctcagccaccaacttaaaaaggactggacaatacttttatcactttcgcttctcagaattcaggcctgtcctcagaatgctacaaggtacagcccatttgagctcctgtatagacgctccttttttttttttatttaagttttagggtacatttgcacattgtgcaggttagttacatatgtatacatgtgccatgctggtgcgctgcacccactaacttgtcatctagcattaggtatatctcccgatgctatccctcccccctccccccaccccacaacagtccccagagtgtgatgttccccttcctgtgtccatgtgatctcattgttcaattcccacctatgagtgagaatatgtggtgtttcgttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcatgtgtgtgaataaacatacgtgtgcatgtgtctttatagcagcatgatttatagtcctttgggtatataaccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggatttgatttgcatttctctgatggccagtgatgatgagcattttttcatgtgtcttttggctgaataaatgtcttcttttgagaagtgtctgttcatgtccttcgcccactttttgatggggttgtttgtttttttcttgtaaatttgtttgagttctttatagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctggctagccatatgtagaaagctgaaactggatcccttccttacaccttatacaaaaatcaattcaagatggattaaagacttaaacgttagacctaaaaccataaaaaccctagaagacactcctttttattaggccccagtctcattcaacaccagaccaacttagactgtccctcaaaaaaacttgtcatccctactatcttttgtctagtcatactcctattcaccattctcaactactcatacatgccctgctcttatttacactgctggtttacactgtttctccaagccatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttctcttattccagtttttcaattcatacaaaactgtatccaggccatcaccagtcattctatacgacaaatgtttcttctgataaccccacaatatcaccccttaccacaagatcttcctttagcttaatctctcccactctaggtttccacaccgcccctaatcctgcttgaagcagccctgagaaacatcgtccattctctctccataccacccccaaaaattttcgccgccccaacacttcaacactattttgttttctttttcttattaatataagaaggcaggaatgtcaggcctctgagcccaagccaaaccatcgcatcccctgtgacttgcacgtatacgtccagatggcctgaagtaactgaagaatcacaaaagaagtgaaaaggccccgtcccgccttaactgatgacattccaccattgtgatttgttcctgccccaccttaactgagtgactaaacctgtgaatttccttctcctggctcagaagctcccccactgagcaccttgtgacccccacccctgcccatcagaaaacaaccccctttgactgtaattttccattaccttcccaaatcctataaaacggccccagcccatctcccttcactgactctctttttggactcagcctgcctgcacccaggtgaataaacagccttgtggctcacacaaagcctgtttggtggtctcttcacatggacgcgcatgaaa

SEQ ID NO: 41 - DNA, 5673 bp, Homo sapiens
gtcaggcctctgagcccaagctaagccatcatatcccctgtgacctgcacgtacacatccagatcgacagttcctgccttaactgataacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccccttttgctttacctacccaaatcctataaaacagctccacccctatctcccttcactgactctctttttggactcagcccacctgcacccaggtgaaataaacagctttattgctcacacaaagcctgttggtggtctcttcacacggacgcacatgaaatttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggtaagcagactcttcttactctcttctccaacctctctcactgtccctcaaccactttctcctttccactcttcaatctcttccttctcttaatttcaattcctttcattttctggtagagacaaaggagacacgttttatccgtggacccaaaactctggcgccagtcatggactagggaaggcagccttcccttggtgtttaatcattggagggacacctctctgattattcgtccaggtttcagaggtgtcagaccacgcagggacgcctgccttggtccttcatccttagtggcaagtcccgcttttctggggaaggggcaagtaccccaaccccttctctctgtgtctctacctcttttccacctttctggggggcaagaaacccccaaccccttttccttcaccctgagcagcaagtcccgcttttctagaggaggggcaagtaccccaacctcatatctctgtgcccccatcccttatttccgtgccccaacctcttatatcgctgtaccccaatccattatttctgtgccctaacctcttatatctctgcaccccaatcccttatttccatgccctgaccttgtatctctgtgccccgacccctttcccgcttttctggagggtaagaacccccaaaccccttccctccatgtctctactctctcttttctctgggtttgtctccttcactatgggcaaccttccaccctccattcctccttcttctcccttagtctgtgttcttaagaacttaaaacctcttcaactctcatctaacctaaaatctaagtgtcttattttcttctgcaatgccgcttgaccccaatacaaactcgacagtagttccaaatagccagaaaacggcactttcaatttttccatccttcaagatctaaataattcttgttgtaaaatgggcaaatggtctgaggtgcctgacatccaggcattcttttacacatcagtccctctatagtctctgttcccaatgcaactcatcccaaatcttcctcctttccctcccacctgtcccctcagtcccaaccccaagcatcactgagtctttctactcttccttttctacagacacatctgacctctcccctcctcgccaggccgagctaggtcccaattcttcctcagcctccggtcctccaccctataatccttttatcatctcccctcctcacacccggtccggcttacagtttcattccgtgactagccctcacctgcccagcaatttactcttaaaaaggtggctgaagctaaaggcatagtcaaggttaatgctcctttttctttatcagacctctcccaaatcagtgagcatttagactctttcatcaaatatgaaaaacccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattctggccctcaaaccccacaacaggatttaatcaacctcgccttcaaggtgtacaataatagaaaaaagttgcaattccttgcctccactgtgagacaaaccccagccacatctccagcacacaagaacttccaaatgcctgaaccacagcgggcaggcgttcctccagaacctcctcccccaggagcttgctacaagtgccagaaatctggccaccaggccaaggaatgcctgcagcccaggattcctcctaagccacgtcccatctgtacggaaccccactggaaatcggactgtccaactcacccggcagccactcccagagcccctggaactctggcccaaggctctcagactccttcccagatcttcttggcttagcggctgaagactgacgctgcccaatcgcctcggaagccccctagaccatcatggatgccgagcttcgggtaactctaacagtgaaggataagtctgtccccatcttaatcaataccaaggctactcactccacattaccttcttttcaagggcctgtttcccttgcctccataactgttgtgggtattgatggccaggcttctaaacctcttaaaagtccccaactctggtgccaaattagacaatactcttttaagcactccttttaattatccccacctgcccagttccctattaggccgagacactttaactaaattatctgcttccctgactattcctggattacagctacatctcattgctgcccttcttcccaatccaaagcctcctttgcgtgctcctcttgtattcccccaccttaacccacaagtataagatacctctactccctccttggcaaccgatcatgcaccccttaccatctcattaaaacctaatcacccttactccaatcaatgccaatatcccatcccacagcatgctttgaaaggattaaagcctgttatcacttgcctgctacagcatggccatttaaagcctataaactctccttacaattcccccattttacctgtcctaaaaccagacaagccttacaagttagttcaggatctgcgccttatcaaccaaattgttttgcctatccaccccgtggttccaaatccatatactctcctatcctcaatacctccctccacaatccattattctgttctggatctcaaacatgctttctttactattcctttccacccttcatcccagcctctcttggctttcacttggactgaccctgacacccactaggctcagcaaattacctaggctgtactgccgcaaggcttcacagacagcccccattacttcagtcaagcccaaatttcatcctcatctgttacctatctcggcataatctcataaaaacacacgtgcgttccctgctgatcgtgtccgattaatctcccaaacctcaatcccttacaaaacaacaactcctttccttcctaggcatggttagtgcggtcagaattcttacacaagagccaggaccgcaccctgtagcctttctgtccaaacaacttgaccttactgttttagcctaggcatcatgtctccgtgcagcggctgctgccaccctaatacttttagaggccgtcaaaatcacaaactatgctcaacttactctctacatttctcataacttccaaaatctattttcttcctcatatctgacgcatatactttctgctccccggctccttcagctgtactcactctttgttaagtcccacaattaccattgttcctggcccggacttcaatccagcctcccacattattcctgataccacacccgacctccatgactgtatctgtctgatcctcctgacattcaccccatttccccatatttccttctttcctgttcctcaccctgatcacgcttgatttattgatggcagttccactaggcctaatcgccacacaccagcaaaggcaggctatgctatagtacaagccactatcccgcctctttgaacctctcatttcctttccatcgtggaaatctatcctcaaggaaataacttctcagtgttccatctactattctaccactcctcagggattattcaggccccctcccttccctacacatcaagcttgaggatttggccccacccaggactggcaaattagctttactcaacatgcccggagtcagataactaaaatacctgttagtctaggtagacactttcactggataggtagagtcctttcctacagggtctgagaaggccaccacagtcattttttcccttctgtcagacataattcctcagtttagccttcctacctcaatacagtctgataacagacaagcttttattagtcaaatcagccaagcagtttttcaggctcctagtattcagtgaaacctttatatcccttacggtcctccatcttcaggaaaagtagaacagactaaaggtcttttaaaaacacacctcaccaagctcagccaccaacttaaaaaggactggataatacttttatgactttcccttctcagaagtcagacctgtcctcagaatactacaaggtacagcccatttgagctcctgtatagacgttcctttttattaggccccagtctcattccagacaccagaacttagactgtgccccccaaaaacttgtcatccctactatcttctgtctagtcatactcctattcaccgttctcaactactcatacatgccctgctattgtttacactgccggtttacagtttctccaagccatcacagctgatatctcctggtgccatccccaaactgccactcttaactcttgaagtaaataaataatctttgctggcaggactatgctgatctccttaggcactctctaagcagatgtcctgagtcatcccaattcttagaccttttatacctgtttttctccttctcttattccgtttagtttttcaattcatacaaaactgttatccaggccatcaccaatacttctaaattacaactattccttctaacaaccccacaatatcaccccttaccacaaaatcttccttcagcttaatctctcccactctaggttcccacgcccccccaatcccactcaaagcagccctgagaaacatcgcccattatctctccataccatcccccaaaatttttgctgtcccaagactttaccactatttcattttatttttcttattaatataagaagacaggaatgtcaggcctctgagcccaagctaagccatcatatcccgtgacctgcacgtacacatccagatcgcgggttcctgccttaactgataacattccaccataaaagaagtgaaaatggcctgttcctgccttaactgatgacattgttttgtgaaattccttctcctggctcatcctggctcaaaagcgcccccactgagtacctgtgccccccactcctgcctgccagagaacaacccccctttttcctttacctacccaaatcctataaaacggccccacccctatctcccttcactgactctctttttggactcagcccacctgcacccaggtgaaataaacagctttattgctcacacaaagcctgtttggtggtctcttcacacggacgcgcatgaaa

SEQ ID NO: 42 - DNA, 7833 bp, Homo sapiens
gtcaggcctctgagcccaagccaagccatcgcatcccctgtgacttgcacatatacacccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcaccgcctaacccaaaacctataagaactaatgataatccatctcccttcactgactctcttttcggactcagcccacctgcacccaggtgaaataaacagctatgttgctcacacaaagcctgtttggtggtctcttcacaaggacgcacatgaaatttggtgccgtgactcggaccaggaccgcaccctgtagcctttctgtccaaacaacttgaccttactgttttagcctaaccctcatgtctgcatgcagtggctgccactgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattactattgttcctggcccggacttcaatctggcctcccacattattcctgataccacacctgacccccatgactgtatctctctgatccacctgatattcaccccatttccccatatttccttctctccgtgtctctaccccttctctgcttttctgggggaggggcaagtacccctcaatcccttctccttcacccttagtggcaagtcctgcttttctggggaaggggcaagtaccccaaccccttctctccttgtctctaccccttctctgcttttctggggaaggggcaagtaccccaaccccttctctccatgtctataccccttctctgattttctggggcaggggaaagaacccctcaaccccttctccttcacccttagtggcaagtcccgcttttctggggaagaggcaagtaccccaaccccttctctccttgtctctaccccttctctgattttctggggcaggggcaagaacccctcaactccttctccttcaccctcagcggcaagtcccacttttctgggggaggggcaagtactccaaccccttctctctgtgtctctatcccttctctgcttttctgggggagaggcaagtaccccaacctcgtatctctgcaccccgatcccttatttctgcaccctgacctcgtatctctgcaccccaaccccttctctgcttttctggagggcaagaaacccccaccccttctccgtgtctctactcttttctctgggcttgcctccttcacgatgggtaagcttccaccttccattcctctttcttctcccttagcctgtgttcttaagaacttaaaacctcttcaactttcacctgacctaaaacctaaatgccttattttcttctgcaatgccgcttgaccccaatacaaactcgacagtagtcccaaatagccagaaaactgcactttgaatttttccatcctgcaagatctaaataattcttctcgtaaaataggcaaacggtctgaggtgcctgaagtccaggcattcttttacacatcagtccctctctagtctctgttccaatgcaactcatcccaaatcttccttctttccctcctgcctgtcccctcagtcccaaccccaagcgtcgctgagtctttctaatcttccttttctacagactcttctgacctctcccctcctcgccaggccgagctaggtcccaattcttcctcagcctccgctcctccaccctataatccttttatcacctcccctcctcacacccagtctggtttacagtttcgttccgtgactagccctcccccacctgcccagcaatttactcttaaaaaggtggctggagctaaagccatagtcaaggttaatgctcctttttctttatcccaaatcagatagtgtttaggctctttttcatcaaacataaaaaacccagcccagttcatggctcattcagcagcaaccctgagacgctttacagccctagaccctaaaaggtcaaaaggccgtcttattctcaatatacattttattacccaatctgctcccgacattaaataaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaatgcctgaactgcagcagccaggcgttcctccagaacctcctcccccaggagcttgctacacatgccggaaatctggccactgggccaaggaatgcccgcagcctgggattcctcctaagccgcgtcccatctgtgcaggaccccactgaaaattggactgttcaactcacctggcagccactcccacagcccctggaactctggcccaaggctctctgactccttcccagatcttctcggcttagcggctgaagactgacgctgcccaatcacctcggaagccccctagaccatcacaggtgccgagcttccagtaactcacagtggaaggtaagtccatccccttcttaatcaatatggaagctacccactccacattaccttcttttcaagggcctgtttcccttgcttccataactgttgtgggtattgacggccaggcttctaaacctcttaaaactccccaactctggtgccagctgagacaatactcttttaagcactccttttagttatccccacctgcccagttcccttattaggccgagacactttaactaaattatctgcttccctgactattccgggattacagctacatctcattgccacctttcttcccaatccaaagccttctttgcgtcctcctcttgtattccccgaccttaacccacaactataagatacccctactccctccttggtgaccgatcatgcaccccttaccatctctttaaaacctaatcacccttaccccactcaatgccaatatcccatcccacagcacactttaaaaggattaaagcctgttatcactcgcctgctacagcataggcttctaaaacctataaactctccttacaattccccaattttacctgtccaaaaacagaacaagtcttacagattagttcaggatctgcgccttatcaaccaaattgttttgcctatccaccccgtggtgccaaacccatatactctcctatcctcaatacctccctctactacccattattctgttctagatctcaaacatgctttctttttttttgaaactttttattttttttggaaactttttactttgatatgatttatttatttatttatttttttttttttattgatcattcttgggtgtttctcgcagagggggatttggcagggccacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccatttaaccctgagtggacatagcacatgtttcagagagcacagggttgggggtaaggtcaccgatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcccggcccgttctcaatgagctgttgggtacacctcccagacggggtggtggccgggcagaggggctcctcacttcccagtaggggcggccgggcagaggcacccctcacctcccggacggggcgactggccgggcggggggctgacccccccatctccctcccggacggggcggctggccaggcagaggggctcacttcccagtaggggtggccgggcagaggcgcccctcacctcccggagggggcggctggccgggcggggggctgatccccccacctccctcccggacggggcggctggccgggcggggggctgacccccccacctccctcctggacggggtggctgccgggcggagacgctcctcacttcccagacggggtggctgccgggcggaggggctcctcacttctcagacggggcggctgctgggcggaggggctcctcacttctcagacagggcggttgccaggcagagggtctcctcacttctcagacggggcggccgggcagagacgctcctcacatcccggacggggcgacagggcagaggcgctccccacatctcagatgatgggtggccgggcagagacgctcctcacttcctagatgggatggcggcctggcagagacgctcctcactttccagactgggcagccaggcagaggggctcctcacatcccagacgatgggcggccaggcagagatgctcctcacttcccagacggggtggcggccgggcagaggctgcaatctcggcactttgggaggccaaggcaggctgctgggaggtggatgttgtagcgagccgagatcatgccactgcactccagcctgggcaccattgagcactgagtgaaggagactccgtctgcaatcccggcacctcgggaggccgaggctggcggatcactcgcggtcaggagctggagaccagcccggccaacacaacgaaaccccgtctccacccaaaaaatacgaaaaccagtcaggcgtggcggcgcgcgcctgcaattgcaggcactcagcaggctgaggcaggagaatcaggcagggaggttgcagtgagccgagatggcagcagtacagtccagcttcggctctgcatcagagggagaccgtggaaagaggggagggggagggggagagggagagggagagggagagggagagggagagggagagggcatgctttctttactattcctttgcacccttcatcccagcctctctttgctttcacttggactaaccctgacacccatcagtcccagcagcttacctgggctgtactgccgcaaggtttcagggacagccctcattacttcagccaagctctgtctcatgatttagtttctttccacccctccgcttctcaccttattcagtatattgatgaccttcttctttgtagcccctcctttgaatcttctcaacaagacacacttctgctccttcagcatttattctccaaaggatagcgggtattcccctccaaagctcaaattttttccccatccattacctacctcggcataattcttcataaaaacacatgtgctctcccttctgatcatgtccgattaatctcccaaacctcaatcccttacaaaacaacaactccttttcttcctaggcatggttagtgtggtcagaattcttacacaagagccaggaccacaccctgtagcctttctgtccaaacaacttgaccttactgttttagcctagccatcatgtctccgtgcagcggctgccactgctttaatacttttagaggccctaaaaatcacgaactgtgctcaactcactctctgcatttctcataacttctgaaatctactttcttcctcatacctgatgcatatactttctgctccctggctccttcagctgtactcactctttgttaagtcccacaattaccattgttcctggcccggacttcaatctggcctcccacattattcctgataccacacctgacccccatgactgtatctctctgatccacctgatattcacccgatttccccatatttccttcttttctgttcctcaccctgatcacgcttgatttattgatggcagttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagcttgaagatttgcccccacccaggactggcaaattagctttactcaacatgccctgaatcaggaaactaaaatacctcttagtctaactagacactttcactgaataagtaaagacctgtcctacagggtctgagaaggccaccgcagtcatttcttctcttctgtcagacataattcctcagtttagccttcccacctctatacagtctgataaaagaccagcctttattagtcaaatcagccaagcagtttttcaggctcttagtactcagtgaaacctttatatcccttacggtcctcagtcttcaagaaaagtagaacagactaaaggtcttttaaaaacacacctcaccaagctcagccaccaacttaaaaaggactggataatacttttaccactttcccttctcagaagtcagacctgtcctcagaatgctacaaggtgcagcccatttgagctcctgtatagacgctcctttttattaggccccagtctcattcgacaccagaccaacttagactgtgaccccaaaaaacttgtcatccctactatcttctctctagtcatactcctattcaccgttctcaactactcatacatgccctgctcttgtttacactgctggtttacactgtttctccaagccatcacagctgatatctcctggtgctatccccaaactgccactctaaactctggaagtaaataaataatctttgctggcaggactatgctgaatctccttaggcactctctaatcagatgtcctaggtcctcccaattcttagaccttttatacctgtttttctccttctcttattccatttagtttctgaattcatccaaaaccgtatccaggccatcaccaataattctatatgacaaatgtttcttctaacatccccacaatatcaccccttaccacaagatctcccttcagcttaatctctcccactctaggctcccacgccacccctaatcccgcttgaagcagccctgagaaacatcacccattctctctccataccaccccccaaaaattttcaccgccctaacacttcaacactattttgttttatttttcttattaatataagaaggcaggaatgtcaggcctctgagcccaagccaagccatcgcatcccctgtgacttgcacatatacaaccagatggcctgaagtaactgaagatccacaaaagaagtaaaaatagccttaactgatgacattccaccattgtgatttgttcctgccccaccctaactgatcaatgtactttgtaatctcccccacccttaagaaggttctctgtaattctcctcacccttgagaatgtactttgtgagatccacccctgcccgcaaaacattgctcttaacttcactgcctatcccaaaacctataagaactaatgataatccatctcccttcactgactctcttttcggactcagcccacctgcacccaggtgaaataaacagccatgttgctcacacaaagcctgtttggtggtctcttcacaaggacgtgcatgaaa

SEQ ID NO: 43 - DNA, 450 bp, Homo sapiens
gtcaggcctctgagcccaagccaagccatcgcatcccctgtgacttgcacttatacgcccagatggcctgaagtaactgaagaatcacaaaagaagtgaaaatgccctgccccgccttaactgatgacattccaccacaaaagaagtgtaaatggccagtccttgccttaagtgatgacattaccttgtgaaagtccttttcctggctcatcctggctcaaaaagctcccccactgagcaccttgtgacccccactcccatccgctagagaacaaacctcctttgactgtaattttcctttacctacccaaatcttataaaatggccccacccctatctcccttctctgactctcttttcggactcagcccacctgcacccaggtggttaaaagctttattgctcacacaaagcctatttggtggtctcttcacatggacgcgcatgaaa

SEQ ID NO: 44 - DNA, 389 bp, Homo sapiens
gtcaggcctctgagcccaagctaagccatcatatccccagtgacctgcatgtatacatccagatggcctgaagcaagtgaagaatcacaaaagaagtgaaaatggccggttcctgccttaactaatgacattaccttgtgaaattccttctcctggctcagaagctcccccactgagcaccttatgacccccccacccctgcccaccagagaacaacaaccccctttgactgtaattttccactacctacccaaatcctataaaacggccccacccctgtctcctttcccagactctcttttcggactcagccagcctgcacccaggtgattagaaagctgtattgctcacacaaagcctgtttgttggtctcttcacacggatgcatg

SEQ ID NO: 45 - DNA, 3720 bp, Homo sapiens
gtcaggcctctgagcccaagccaagccatcgcatcccctgtgacttgcaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccggtaactctcacagtgcaaggtaggcccgtccccttcttaatcaatacggaggctactcactccccattaccttcttttcaagggcctgtttcccttgcctccataactgttgtgggtattgacggtcaggcttctaaacctcttaaaactccccaactctggtgccaacttagacaatactcttttaagcactcctttttagttatccccacctgcccagttcccgtattaggctgagacactttaactaaattatctgcttccctgactattcctggactacagctatatctcattgccgcccttcttcccaatccaaagcctcctttgcgtcctcctcttgtatcccccgaccttaacccacaagtataagatacctctactccctccttggtgaccgatcatgcaccccttaccatctcattaaaacctaatcacccttaccccactcaacgccaatatcccgtcctgcagcatgctttaaaaagattaaagcctgttatcactcacctgctacagcatggccttttaaagcctataaactctccttacaattcccccgttttacctgtcagccctgagaaacatcgcccattctccctccataccaccccccaaaaattttcaccgctccaacacttcaacactattttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccaggtgaaataaacagccatgttgctcacacaaagcctgtttggtggtctcttcacacagacgcgcatgaaa

SEQ ID NO: 46 - DNA, 6012 bp, Homo sapiens
gtcaggcctctgagcccaagccaaccatcccagcccctgtgacttgcacatatatgaccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcctgccagagaacaaaccccctttgactgtaattttcctttacctacccaaatcctataaaacggccccacccttatctcccatcgctgattctctttttggactcagcccgcctgcacccaggtgaaataaacagccatgttgctcacgcaaagcctgtttggtggtctcctcacacggacgcgcatgaaatttggtgctgtgactcagaatgggggacctcccttgggagatcaatctcccgtcctcctgttctttgctccatgagaaagatccacctacgacctcaggtcgtcagacagaccagcccaagaaacatctcaaatccggtaagcggcctctttttactctcttctccaacctccctcactatccctcaacctctttctcctttcaatcttggtgccacacttcaatctctcccttctcttaatttcaattcctttcattttctggtagagacaaaggagacacgttttatccgtggacccaaaactccggcgctggtcacggactgggaaggcagccttcccttggtgtttaatcattgcagggacacctctctgattattcacccacgtttcaaaggtgtcagaccacgcagggacgcctgccttggtccttcacccttagtgtcaagtcccacttttctggggaaggagcaagtaccccaaccccttctctccttgtctctaccccttctctgcttttctgggggacggacaagtacccctcaaccccttctccttcacccttagtggcaagtcctgcttttctacggggcaagaacccccaatcccttatttctgcgccccaacctcttatctctgtgccccaataccttatttccatgccccaacctcttatatctctgccccccaatcccttatttccgcgccccaacctcttatatctctgcgccccaatcccttatttccacgccccaacctcttatttctgcaccccatcccttatttctgtgccacaaccccttttcccacttttctggaaggtaagaacccccgaaccccttccctccatttctctactctcttttctctaggcttacttccttcaccatgggcaaccttccaccctccattcctccttctactcccttggcctgtgttctcaaaaacttaaaacctcttcaactcacacctgacctaaaacctaaatgccttattttcttctgcaatgctgcttgaccccaatataaactcgacagtagttccaaatagccagaaaatggcactttgaatttttccatcctgcaaaatctaagtaattcttgtcgtaaaataggcaaatggtctgaggtgcctgatgtccaggcattcttttacacatcagtcccttcctggtctctgtgaccagtgcaactggtcccaaatcttccttctttccctcccgcctgtctcctcagtaccaatcccaagcgtcgctgagtctttctaatcttccttttctacagacccatctgacctctcccttcctccccaggctgctcctcaccaggccgagctaggtcccaattcttcctcagcctctgctcctccaccctataatctttttatcacctcccctcctcacacctggtccgactagccctccccctcctgcccagcaatttactcttaaaaaggtggctggagctaaaggcatagtcaaggttaatgctcctttcctttttgtttatcccaaatcagatagtgtttaggctctttttcatcaaatataaaaatccagcccagttcatggctcgtttggcagcaaccctgagacactttacagccctagaccctaaaaggtcaaaaggccgtcttattctcaaaatacattttattacccaatctgctcccgacattaaataaaactccaaaaattggaatctggccctcaaaccccacaacaggacttaattaacctcaccttcaaggtgtacaataacagaaaaaaagttgcaattccttgcctccactgtgagacaaaccccagccgcatctccagcacacaagaacttccaaatgcctgaaccgcagcagctaggcattcctccagaacctcctcccccaggagcttgctacacgtgctggaaatctggccaccgggccaaggaatgcccgtagcccgggattcctcctaagccgcgtcccatctgtgtgggaccccactgaaaatcggactattcaactcacctggcagccactcccagagcccctggaactctggcccaaggctctctgactgactccttcccagatcttctcggcttagcggctgaagactgacactgcccgatcgcctcggaagccccctagaccatcacagacaccgagcttcgggtaactctcacagtggaaggtaagcctgtccccttcttaatcaatacggaggctccccactccacattaccttcttttcaagggcctgtttcccttgcctccataactgttgtgggtattgacggccaggcttctgaacctcttaaaactccccaactctggtgccaacttagacaatactcttttaagcactcctttttagttatccccacctgcccagttcccttattaggctgagacactttaactaaattatctgcttccctgactattcctggactacagctatatctcattgccgcccttcttcccaatccaaagcctcctttgcgtcctcctcttgtatccttccaccttaacccacaagtataagatacctctactccctccttggcgaccgatcatgcaccccttaccatctcattaaaacctaatcacccttaccacactcaatgccaatatcccatcccgcagcacactttaaaaagattaaagcctgttatcactcgcctgctactgcatggccttttaaagcctataaactctccttacaattcccccattttacctgtcctaaaaccagacaagccttacaagttagttcaggatctgcgccttatcaaccaaattgttttgcctatccacctcgtggtgccaaacccatatactctcctatcctcaatacctgcctctacaacccattattctgttctagatctcaaacatgctttctttactactcctttgcacccttaatcccagcctctctttgctttcacttggactgaccctgacacccatcaagctcagcaaattacctaggctgtactgctgcaaagcttcacagacagcccccattacttcaatcaagcccaaatttcttcctcatctgttacttatctcagcataattctcataaaaacacacgtactctccctgccaattgtgtccgactgatctctcaaaccctaaccacttctacaaaacaacaactcctttccttcctgggcatggttggatactttcgcctttggatacctggttttgccatcctaacaaaaccattatataaactcacaaaaggaaacctagctgaccccatagatcctaaatcctttccccactcctctttccattccttgaagacagctttagaaactgcccccaccctagctctccctgactcatcccgacccttttcattacacacagccgaagtgcagggctgtgcagtcggaattcttagataaggacaacgatcgcgtcctgtagcctttttgtccaaacaacttgaccttattgttttaggctggccatcatgtctctgtgcagccgctgctgctgccctaatacttttagaggccctcataatcacaaactatgctcaactcactctctacagttctcataacttccaaaatctattttcttcctcatacctgatgcatatactttctgcttcccggctccttcagctatactcactctttgttgagtctcccacaattactgttgttcctggcccagacttcaatccggcctcgcacattattcctgataccacacctgacccccatgactgtatctctctgatccacctgacattcaccccatttccccaaatttccttcttccctgttcctcaccctgatcacgcttgatttattgatggctgttccaccaggcctaatcgccacacaccagaaaggcaggttatgctatagtacaagccactagcccacctcttaaaacctctcatttcctttccatcgtggaaatctatcctccaggaaataacttctcagtgttccatctgctattctactactcctcagggattattcaggccccatcccttccctacacatcaagctcgaggactggcaaattagctttactcaacatgcccaagtcaggaaactaaaatacctcttagtctaaatagacactttcactgaataagtaaaggcctttcctacagggtctgagaaggccaccgcagtcatttcttcccttctgtcagacataattcctcagtttagccttcccacctcaatacagtctgataacagatgagcctttattagtcaaatcaggcaagcagtttttcaggctcttagtattcagtgaaacctttatatcccttacggtcctccatcttcaagaaaagtagaatggactaaaggtcttttaaatacacacctcaccaagttcaccaacttaaaaaggactggacaatacttttactacatttccttctcagaattcaggcctgtcctcggaatgctacagggtacagcccatttaagctcctgtatagacgctcctttttattaggccccagtctcattccagacaccagaccaacttagactgtgtcccaaaaaaacttgtcatccctatcttctgtctagtcatactcctattcaccgttctcaactactcatacatgccctgctcttgtttagccggtttacactgtttttccaagccatcacagctgatatctcctggtgctatccccaaactgccactcttaactcttgaagtaaataaataatctttgctggcaggactatgccgaatctccttaagcactctctaatcagataatcctgagtcgtcccaattcttagaacttttatacctgtttttctccttctgttattccatttagtttttcaattcatacaaaaccgtatccaggccatcaccaatcattctatatgacaaatgttccttctaacatccccacaatatcaccccttaccacaagatctcccttcagcttaatctctcccactctaggttcccacgccgcccctaatcccgcttgaagcagccctgagaaacatcgcccattctctctccataccaccccccaaaaattttcgccactccgacacttcaacactattttgttttatttttcttattaatataagaaggcaggaatgtcaggcctctgagcccaagccaagccatcccatcccctgtgacttgcacatatatgaccaaatggcctgaagtaactgaagaatcacaaaagaagtgaatatgctctgccccacattaactgatgacattccaccacaaaagaagtgtaaatggccggtccttgccttaactgatgacattaccttgtgaaagtccttttcctggctcatcctggctcaaaaagcacccccactgagcaccttgtgacccccactcctgcccgccagagaacaaaccccctttgactgtaattttcctttacctacccaaatcctataaaacggccccacccttatctcccatcactgattctctttttggactcagcccgcctgcacccaggtgaaataaacagccatgttgctcacacaaagcctgtttggtggtctcttcacacagacgcgcatgaaa

SEQ ID NO: 47 - DNA, 238 bp, Homo sapiens
tacagttgatagctagtcagacacgagcaggataggagagggctccctgccctcaccaccaggaatgttgatggtggtgacggtcaggtggttgttaactgtctctgtaaagtaataattggttgcagccagtgccagggaagggcagtcttccagtagatagaaaacacctaaaactggtgatcagcagcttcctgataagacctcaggagttgggcaagtgggctcaggtgagcac

SEQ ID NO: 48 - DNA, 2205 bp, Homo sapiens
tgaggtcagaattcttacacaagagccaggaccgcaccctgtagcctttctgtgcaaacaacttgaccttactgttttagcctagccctcatgtctgtgtgcagcagctgccgctgctttaatacttttagaggccctcaaaatcacaaactatgctcaactcactctctgcagttctcataacttccaaaatctattttcttcctcatacctgatgcatatactttctgctccccggctccttcagctgtactcactctttgttgagtctcccacaattaccgttgttcctggcccagacttcaatccggcctgccacattgttcctgataccacacctgacccccatgactgtatctctctgatccacctgatattcaccccatttccccaaatttccttctttcctgttcctcaccctgatcacgcttgatttattgatggcggttccaccaggcctaatcgccacacaccaccagcaaaggcaggttatactatagtacaagccactagcccgcctcttagaacctctcatttcctttccattgtggaaatttatcctcaaggaaataacttctcagtgttccatctgctattctactactcctcagggataattcaggccccctccctttcccacacatcaagctcgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagaagggcctttattagtcaaaacagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccattggagctcctgtatagatgctcctttttattaggccccggtctcattccagacaccagaccaacttagactgtgcccctaaaaaacttgtcttccctgctatcttctgtctagtcatactcctattcaccgttcctaactactcatacatgccctgctcttgtttacactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcgtcccaattcttaagactttttatacctgtttttctccttctgttattccatttagtttctcaattcatccaaaaccgtatctaggccatcagcaatcattctataggacaaatgtttcttctaacatccccacaatatcaccccttaccacaagacctcccctcagcttaatctctcccactctaggttcccacgctgcccctaatcccgcttgaagcagccctgagaaacatcgcccattctctctccataccacgccccaaaaatttttgccgccccaaaacctcaacactattttatttttcttattaatataagaaggcaggaatgtcaggcctctgagcccaagccaagccatcacatcccctgtgacttgcatgtatatgcccagatggcctgaagtaactaaagaatcacaaaagaagtgaatgtgacctgccccaccttaactgatgacattccaccacaaaagaagtgtaaatggccggtccttgcctcaagagatgacattaccttgggaaagtccttttcctggctcatcctggctcaaaaagcacccccactgagcaccttgcaacccccactcctgcccgccagagaacaaaccccctttgactgtaattttcctttacctacccaaatcctataaaacggccccacccctatctcccttcgctgactctttttggactcagcccacctgcacccaggtgaaataaacagccatgttgctcacacaaagcctgtttgctggtctcttcacagatacgcgcatgaaa

SEQ ID NO: 49 - DNA, 430 bp, Homo sapiens
gtcaggcctctgagcccaagctaagccatcatatcccctgtgacctgcatgtatacatccagatggcctgaagcaagtgaagaatcacaaaagaagtgaaaatggctagttcctgcctaaactgatgacattccaccattgtgatttgtttctgccccaccttaactgagcgattaaccttgtgaaattccttctcctggctcagaagctcccccactgagcaccttgtgacccccacccttgcccacaagagagcaaccccctttgactgtaattttccactacccacccaaatcctataaaacggccccacccctatctcccttcgctgactgtttttggactcaagccacctgcacccaggtgaaataaacagccctgttactcacacaaatcctgtttggtggtctcttcacacggatgcgcgtga

SEQ ID NO: 50 - DNA, 371 bp, Homo sapiens
gtcaggcctctgagcccaggccaggccatcgcatcccctgtgacttgcacgtacacatccagatggcctgaagtaactgaagatccacaaaagaagtaaaaacagccttaactgatgacattccaccattgtgatttgttcctgccccaccctaactgatcaatgtactttgtaatctcccccgcccttaagaatgtactttgtgagatccccgcctgcccaccagagaacaaccccctttgactgtaattttccattaccttcccaaatcctatgaaatggccccacccctatctcccttcgctgactctctttttggactcagcccgcctgcacccaggtgaaataaacagccatgttgctcaaaaaaa

SEQ ID NO: 51 - DNA, 5517 bp, Homo sapiens
gtcaggcctctgagcccaggctaagccatcatgtcccctgtgacctgcatgtacacatccagacggctggttcctgccttaactgctgacattccaccacaaaagaagtgaaaatgtcctgttcctgcctcaactgatgacattgtcttgtgaaattccttctcctggctcatcctggctcaaaagctcccccactgagtaacttgtaacccccactctgcccgccagagaacaaccccccctttgactggattgggtaggatttacctacccaaatcctataaaacggccccacccctatctcccttccctgactctctttttggacccagcacacctgcacccaggggaaataaacagctttattgctcacagaaagcctgtttggtggtctcttcacacagacacgagtgaaatttggtgctgtgacttggatcgggggacctcccttgggacatcaatcccctgtcctcctgttctttgctccgtgagaaagatccacctacaacctcaggtcctcagactgaccagcccaagaaacgtctcaccaatttcaagtatggtaagtggcctctttttactctctcctccaacctcacttactatccctcaacctctttctcctttcaatcttggcaccacacttcaatctctcccttcttttaatttcaattcctttcattttctggtagagacaaaggagacgcgttttatccgtggacccaaaactccagtgctggtcacggactgggaaggcagccttcccttggtgtttaatcatttcagggacgcctctctgattattcacccatgtttcagaggtgtcagaccacgcagggacgcctgtcttggtccttcacccttagaggcaagtcccgcttttctaggggaggggaaagtaccccaacctcatatctctgtgccctgatcccttatttccacaccccaacctcttatatctctgtgccccgatcccttatttccgtgcccctacctctcccgcttttctggagggtaagaacccccaaaccccttccctccgtttctctactctctcttttctctgggcttgcctccttcactgtgggcaaccttccaccctccattgctccttctcccttagcctgtgttcttaagaacttaaaacctcttcagctctcacctgacctaaactctcagcatcttattttcttccgcaatgccacctgaccgcaatacaaactcgacagtagttccaaatagccagaaaacggcactttcaatttttccatcctgcaagatctaaataattcttgttgtaagatgggtaaatggtctgaggtgcctgacgtccaggcattcttttacacgtcggtccctctctagtctctgttcccaatgcaactcatcccaaatcttccttctttccctcccacccgtcccctcagtcccaaccccaagggtcgctgagtctttctaatcttccatttctacagacccatctgacctctcccctcctccccaggctgctcctcgccaggccgagctacgtcccaattcttcctcagcctctgctcctccaccctataatccttttatcacctcccctcctcacacctggtccggcttacagtttcgttccgtgaccagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctcccgacattaaataaaactccaaaaattaaattccggcccttaaacccctcaacaggatttaattaacctcaccttcaaggtgtacaataatagaaaaaagttgcaattccttgcctccactgtgagacaaaccccagccacatctccagcacacaagaacttccaaacgcctgaaccacagcggccaggccttcctccagaacatcctcccccaggagcttgctacaagtgccagaaatctggccaccaggccaaggaatgcctgcagcccgggattcctcctaagccacgtcccatctgtgcgggaccccactggaaatcggactgtccaactcacctggcagccactcccagagcccctggaactctggcccaaggctctctgacggcttcccagatcttcttggcttagcggctgaagactgactctgcccgatcacctcggaagccccctaggccatcacggacgccgagcttcgggtaactctcacggtggaagctaagcccgtccccttcttaatcaatacggagcctacccactccacattaccttcttttcaagggcctgtttcccttgcctccataactgttgtgggtattgacggccaggcttctaaacctcttaaaactccccaactctggttccaacttagacaatactcttctaagcactccttttagttatccccacctgcccagttcccttattaggccgagacactttaactaaattatctgcttccctgactattcctgtattacagctacatctcattgctgcccttcttcccaatccaaagcctcctttgcgtcctcctcttgtattctcccaccttaacccacaagaataagatacctctactccctccttggcgaccgatcatgcaccccttactatctcattaaaacctaatcacccttaccccgctcaatgccaatatcccatcccacaccatgctttgaaaggattaaagcctgttatcactcacctgctacagcatggccttttaaagcctataaactctccttacaattcccccattatacctgtcctaaaaccagacaagccttccaagttagttcaggatctatgccttatcaaccaaattgttttgcctatccaccccatggtgccaaacccatatactctcctatcctcaatacctccctccacaatccattattctgtgctggatctcaaacctgctttctttactattcctttgcacccatcatcccagcctctcttcgctttcacctggactgaccctgacacccatcaggctcaggaaattacctgggctgtactgccgcaaagtttcacagacagcccccattacttcagtcaagcccaaatttattccttatctgttacctatctcagcataattctcataaaaacacacgtgctctccctgctgatgtccaattaatctcccaaacctcaatcccttacaaaacaacaactcctttccttcctaggcatggtttgtgcggtcagaattcttacacaagagccaggaccgcaccctgtagcctttctgtccaaacaacttgaccttactgttttagcctagccctcatgtctgcgtgcgtggctgctgccaccctaatacttttagaggccctaaaaatcacaaactatgctcaacttactctctacatttctcataacttccaaaatctattttcttcctcatacctgacgcatatactttcggcttcctggctccttcagctatactcactctttgttaactcccacaattaccattgttcctggcccggacttcaatctggcctcccacattattcctgataccacacctgacctccatgactgtatctctctgatccacctgacattcaccacatttccccatatttccttctttcctgttcctcaccctgatcacgcttgatttattgatggcagttccaccaggcctaatcgccacacaccagcaaaggcaggctatgctatagtacaagccactagcccccctcttagaacctctcattttctttccatcgtggaaatctgtcctcaaggaaataacttctcagtgttccatctgctattctactactcctcagggattattcaggccccctcccttccttacacatcaagctcgaggatttgcccctacccaggactggcaaattagctttactcaacatgccccgagtcagataactaaaatacctcttagtctaggtagacactttcactggataggtacaggcctttcctacagggtctgagaaggccaccgcagtcatttcttcccttctgtcagacacaattcctcagtttagccttcccacctcaatacagtctgataacagacgagcctttattagtcaaatcagccaagcagtttttcaggctcttagtattcagtgaaacctttatatcccttatggtcctccgtcttcaggaaaagtagaatggactaaaggtcttttaaaaacacacctcaccaagctcagtcaccaacttaaaaaggactggacaatacttttaccactttcacttctcagaactcaggcctgtcctcggaatgctacagggtacagcccatttgagctcctttttttattaggccccagtctcattccagacaccagaccaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaaccgccactcttaactcttaaagtaaataaataatctttactggcaaggctatgctgaaccaccttaggcactctctaattagatgtcgtaggtcctcccaattctgagtcctttaatacctgtttttctccttctcttattctgtttagtttttcaattcatacaaaactgtatccaggccaacaccaataattctaaataacaaatgtttcttctaacagccccacaatatcaccccttgccacaaaattttccttcagcttaatctctcccactctaggttcccacgccgcccctaatcccgctcgaagcagccctgagaaacatcacccattatctctccataccaccaaaaaattttcactgtcccaacactttaccactatttcattttattgttcttattaatataagaagacaggaatgtcaggcctctgagcccaagctaagccatcacataccctgtgacctgcaggtacacatccagatggctggttcctgccttaactgctgacattccaccacaaaagaagtgaaaatgtcctgttcctgccttaactgatgacattgtcttgtgaaattccttctcctggctcatcccggctcaaaagctcccccactgagtaccttgtgacccccactctgccggccagagaacacccccctttgactgtaattttcctttatctacccaaatcctataaaacggccccacccctatttcccttcgctgactctctttttggactcagcccacctgcacccaggtgaaataaacagctttattgctcacacaaagcctgtttgatggtctcttcacatggatgagagtgaaa

SEQ ID NO: 52 - DNA, 3427 bp, Homo sapiens
gtcaggcctctgagcccaggccaggccatcacatcccctgtgacttgcacgtatacatccagatggcctgaagtaactgaagatccacaaaagaaataaaaacagccttaactgatgacattccaccattgtgatttgttcccgccccaccctaactgatcaatgtactttgtagtctcccccacccttaagaaggttctttgtaattctccccactcttgagaatgtattttgtgagatccacccctgcccaccagagaacaaccccctttgactgtaattttccattaccttcccaaatcctataaaacggccccactcccttcgctgactctcttttcggactcagcccgcctgcacccaggtgaaataaacagccatgttgctcacacaaagcctgtttggtggtctcttcacacggacgcgcatgaaatgtggtgccgtgactcggatcgggggacctcccttgggagatcaatcccccgtcctcctgctctttgctccgtgagaaagatccacctctatgacctcaggtcctcagaccgaccagcccaagaaacatctcaccaatttcaaatccggtaagcggcctcttttgactctcttctccaacctccctcactatccctcaacctctttctcctttcaatcttggtgccacacttcaatctctcccttaatttcaattcctttcattttctggtagagacaaaagagacacgttttatccgtggacccaaaactccggcgccggtcacggactgggaaggcagccttcccttggtgtttaatcattgcagggacgctctctgattatacacccacgtttcaagggtgtcagaccacgcagggacgcctgccttggtccttcacccttagcggctagtcccgcttttctggggaaggggcaagtacccgtgaaccccttctccttcaccctcagcggcaagtcccgctttcctggggcaggggcaagtacccctcaaccccttctccttcaccctcagcggcaagtcccactttcctggggcaggggcaagtacccctcaaccccttctccttcacccttagcggcaagtcccgcttttctagggggcaagaacccccaaaccccttccctccgggtctctatgctctcttttctctgggtttgcttccttcactatgggcaaccttccaccctccattcctcctccttctcccttagcctgtgtgctcaagaacttaaaacctcttcaactcacacctgacctaaaacctaaatgccttattttcttctgcaatgccgcttgaccccaatacaaactcaacagtagttccaaatagccagaaaatggcactttaaatttttccatcctgcaagatctaaataattcttgtcgtaaaataggcaaacggtctgaggtgcctgacgtcccggcattcttttacacatcagtcccttcctagtcgctgtgcccagggcaactcctcccaaatcttccttctttccctcccgcctgtcccctcagtcccaaccccaagcatcactgactctttctaatcttccttttctacagacccatctgacctctcccctcctcaccaggccgagctaggtcccaattcttcctcagcctccgctcctccaccctataatccttttatcacctcccctcctcacacctggtcctgcttatggttttcattccgtgactagccctcccccacctgcccagcaatttactcttaaaaaggtggctggagctgaaggcatagtcaaggttaatgctcctttttctttatcccaaatcagatagcgtttaggctctttttcatcaaatataaaaacccaacccagttcatggcagcaaccctgagacgctttacagccctagaccctaaaaggtcaaaaggctgtcttattctcaatatacattttattacccaatctgctcccgacattaaataaaactccaaaaattaaattccggccctcaaaccccacaacaggattgaattaacctctccttcaaggtgtacaataataggaaaaagttgcaattccttgcctccactgtgagacaaatcccagccacatctccagcacacaagaacttccaaacgcctgaaccgcagtggccaggtgttcctccagaacctcctcccccaggagcttgctacaagtgccagaaatctgaccaccaggccaaggaatgcccgcagcccaggattcctcctaagccgtgtcccatctgtgcgggaccccactggaaattggactgttcaactcacctggcagccactcccagagcccctggaactctggcccgaggctctctgactgactccttctcggcttagcggctgaagactgatgctgcccgatcgcctcggaagccccatagaccatcacggacgccgagcttccggtaactctcacagcggaaggtaagcccgtccccttcttaagcaatacggaggctacccactccacattaccttcttttcaagggcctgtttcccttgcctccataactgttgtgggtattgacagacaggcttctaaacctcttaaaactccccaactctggtgccaacttagacaatactcttttatgcactcttttttagttatccccacctgcccagttcccttattagaccgagatattttaaccaaattatctgcttccctgactattcctggactacagctgcatctcattgctgcccttcttcccaatccaaagcctcctttgcgtcctcctcttgtattcccccaccttaacccacaagtataagagacctctactccctccttggcaactgatcacgcaccccttaccatctcattaaaacctaatcatccttaccccgctcaatgccaatatcctatcccacagcacgatttaaaaggattaaagcctgtgatcactcgcctgctacagcacgggcttctaaaacctataaactctccttaccattcccccattttacctgtcctaaaaccagacaaggcttacaagttagttcagaatctgcgccttatcaaccaaattgttttgcctatccaccccgtggtgccaaacccatatactctcctatcctcaataccttcctctactacccattattctgttctggatctcaaacatgctttctttactattcctttgcacccgtcatcccagcctctctttgccttcacttagactgaccctgacacccattaggctcagcaaattacctgggctgtactgccgcaaggcttcacagacagcccccattacttcagtcaagcccaaatttcgtcctcatctgttacctatcttggcataattctcataaaaacacatgtgctctccctgctgatcgtgtctgattaatctcccaaacctcaatcccttacaaaagaacaactcctttccttcctaggcatgcttag

SEQ ID NO: 53 - DNA, 2930 bp, Homo sapiens
aactcagatcgggggacctcccttgggagatcaatcccctgtcctcctgttctttgctccatgagaaagatccacctatgacctcaggtcctcagaccaaccagcccaaggaacatctcaccaattttaaatcgggtaagcggcctcttcttactctcttctccaacctctctcactaaaccctcaaccactttctcctttccactcttcaatctctcccttctcttaatttcaattccttttgttttctggtagagacaaaggagacacgttttatccgtggacccaaaactccggcaccagtcacggaatagggaaggcagccttcccttggtgtttaatcattgctgggatgcctttctgattattcaggtgtcagaccacgcagggacgcctgccttggtccttcacccttagcggcaagtcccgcttttctggggaaggggcaagtaccccaaccccttatatctctgtgccccgatcccttatttccgcaccccaacctcatatctctgcgccccaatcccttatgtccgcaccccgacctcgtatctctgtgccctgacccctttcccgcttttctggagggtaagaacccccgaaccccttccctccatgtctctactctctcttttctctgggcttcactatgggcaaccttccaccctcaatttctccttattctcccttagcctgtgttcttaagaacttaaaacctcttcaactctcacctgacctaaaatctaagtgtcttattttcttctgcaatgccgcttgaccccaatacaaagtcgacagtagttccaaatagccagaaaacgacactttcaatttttccatcctgcaagatctaaataattcttgtcgtaaaataggcaaatggtctgagatgcctgacgtccaggcactcttttacacatcggtccctttccagtctctgttcccaatgcaactcatcacaaatcttccttctttccctcccacctgtcccctcagtcccaaccccaagcgtcgctgagtctttctaattttccttttctacagacccatctgacctcttcccttctccccaggctgctcctcaccaggctgagctaggtcccaattcttgctcagcctctgctcctccaccctataatccttttatcacctcccctcctcacacccggtccggcttacagtttcgttccatgactagccctccccctcctgcccagcaatttactcttaaaaaggtggctggagctaaaggcatagtcaaggttaatgctcctttttctttatcccaaatcagatagcgtttaggctctttttcatcaaatataaaaatccagcccagttcatggctcgttcggcagcaaccctgagacactttacagccctagaccctaaaaggtcaaaaggccgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacataagaacttccaaacgcctgaaccgcagcagcccggcattccaccagaacctcctcccccaggagcttgctacaagtgccagaaatctgaccaccaggccaaggaatgcctgcagcccaggattcctcctaagccatgtcccatctgtgcgggaccccactggaaatcagactgttcaactcacctggcagccactcccagagcccctggaactctggccgaaggctctctgactgactccttctcggcttagcggctgaagactgacgctgcctgatagccttggaagccccgtagaccatcacggacgccgagccttaggtaactctcacagtggagggtaagtccgtccccttcttaatcaatacggaggctacccactccacattaccttcttttcaagggcctgttgcccttgcctccataagtgttgtgcgtattgacagccaggcttctaaactaaaactccccaactctggtgccaacttagacaatactcttttaagcactccttttagttatccccacctgcccagttcccttattaggccgagacactttaactaaattatctgtttccctgactattcctggattacagctacatctcattgccgcccttcttcccaatccaaagcctcctttgcgtcctcctcttgtatctccccaccttaacccacaagtataagatacctctactccctccttggcgaccgatcatgcaccccttaccatctcattaaaacctaatcacccttactccgctcaatgccaagatcccgtcccacagcacgctttaaaaggattaaagcctgttgtcactcgcctgctacagcgtggccttttaaatcctataaactcttcttacaattcccccattttacctgtcctaaaaccagacaagccttacaagttagttcaggatctgcatcttatcaaccaaattgttttgcctatccaccccatggtgccaaacccatatactctcctatcctcaatacctccctccacaatcccttattctgttctggatctcaaacatgctttctttactattcctttgcacccttaatcccagcctctcttcgatgtcacctggactgaccctgacacccattaggctcagcaaattacctgggctgtactgccgcaaggcttcacagacagcccccattacttcagtcaagcccaaatttcttcctcatctgttacctatctcagcataatgctcataaaaacacacgtgctctcccagctgatcatgttcgattaatctcccaaacctcaatcccttacaaaacaacaactcctttccttcctaggcatagttag

SEQ ID NO: 54 - DNA, 5525 bp, Homo sapiens
gtcaggcctctgagctgaagctaagccatcatatcccctgtgacctgcacgtacacatccagatggccggttcctgccttaactgatgacgttccaccacaaaagaagtgaaaatggcctgttcccgccttaactgatgacattgtcttgtgaaattccttctcctggctcatcctggctcaaaagctcccctgctgagcaccttgtgaccttcccgcctccccccaccccgctctgcccgccagagaacaaacccctttgactgtaattttcctttatccacccaaatcctataaaacggccccacccttatctccctttgctgactctcttttcggactcagcccgcctgcacccaggtgaaataaacagccatgttgctcacacacagcctgtttggtggtttcttcacacggccgcgcatgaaatttggtgccgtgactcggatcgggggacctcccttgggagatcaatcccccatcctcctgctctttgctgtgtgagaaagatccacctatgacctcaggtcctcagaccgaccagcccaagaaacatctcaccaatttcaaatccggtaagcggcctctttttactctcttctccaacttccctcactatctctcaacctcttgctcctttcaatcttggtgccacacttcaatctctcccttctctcaatttcaattcctttcatattctggtggagacaaaggagacacgttttatccatggacccaaaactccagcgctggtcacagactgggaaggtagccttcccttggtgtttaatcattgcagggacgcctctctgattattcacccatgtttcaaaggtgtcagaccacgcagggacgcctgccttggtccttcacccttagcggcaagtcccgcttttctgagggaggggcaagtacccctcaaccccttctccttcacccttagcggtaagtcccgcttttctatggggcaagaacccccaatcccttatttccacaccccgacccctttcccgcttttctggagggtaagaacccccgaacctcttccctccgtgtctctactctctcttttctctgggcttgcctccttcactatgggcaagcttccaccttccatttctccttcttctccctaagcctgtgtcctcaagaacttaaaacctcttcaactcacacctgacctaaaacctaaatgccttattttcttctgcaatgccgcttgaccccaatacaaactcgacagtaattccaaatagccagaaaatggcactttgaatttttccatcctgcaagatctaaataattcttgtcgtaaaataggcaaacggtctgaggtgcctgacgtccaggcattcttttacacatcggtcccttcctagtctctgtgcccagtgcaactcatcccaaatcttccttctttccctcccgcctgtcccctcagtcccaaccccaagcatcgctgagtctttctaatcttccttttctacagacccatctgacctctcccctcctcgccaggccgagctaggtcccaattcttcctcagcctccgctcctccaccctataatccttttatcacctcccctcctcacacccggtccagcttacagtttcgttccgtgactggccctcccccacctgcccagcaatttactcttaaaaaggtggctggagctaaaggcatagtcaaggttaatgctcctttttctttatcccaaatcagatagcgtttaggctctttttcatcaaatataaaaacccagcccagttcatggctcgtttggcagcaaccctgagacgctttacagccctagaccctaaaaggtcaaaaggccgtcttatgctcaatatacattttattacccaatctgctcccgatattaaataaaactccaaaaattaaattccggccctcaaactccacaacaggatttaattaacctcgccttcaaggtgtacaataatagaaaaaagttgcaattccttgcctccactgtgagacaaaccccagccacatctccagcacacaagaacttccaaacgcctgaacctcagcggccaggcattcctccggaacctcctcccccaggagcttgctacaagtgcccgaaatctgaccaccaggccgaggaatgcctgcagcccaggattcctcccaagccgtgtcccatctgtgcgggaccccactggaaatcggactgttcaactcacctggcagccactcccagagcccctggaactctggcccaaggctctctgactgactccttctctgcttagcagctaaagactgacattgcccgatagcctcggaagccccgtagaccatcacggatgccgagctttaggtaaccctcacagtggaaggtaagtccgtccccttcttaatcaatacggaggctacccactccacattaccttcttttcaagggcctgtttcccttgcctccataactgttgtgggtattgacagccaggcttctaaaccccttaaaactccccaactctggtgccaacttagacaatactcttttaagcactcctttttagttatccccacctgcccagttcccttattaggccgagatattttaaccaaattatctgcttccctgactattcctggaccacagccgcatctcattgctgcccttcttcccaatccaaagcctcctttgcgtcctcctcttttgtattcccccccaccttaacccacaagtataagatacctctactccctccttggcgaccaatcatgcaccccttaccatctcattaaaacataatcacccttaccccactcaatgccaatatcccatcccacagcatgctttgaaaggagtaaagcctgttatcacatgcctgctacagcatggccttttaaagcctataaactctccttacaattcccccattttacctatcctaaaaccagacaagccttacaagttagttcaggatctatgccttatcaaccaaattgttttgcctatccaccccatggtaccaaaccatatactctcctatcctcaatacctccctccacaatccattattctgttctggatctcaaacatgctttctttacaattcctttgcacccgtcatcccagcctctctttgctttcacttggactgaccctgacatccattaggctcagcaaattacccgggctgtactgctgcaaggcttcacagacagcccccattacttcagtcaagcccaaatttcatcctcatctgttacctgtctcagcataattctcataaaaacacacgtgctctccctgctgatcatgtctgattaatctcccaaacctcaatcccttacaaaacaacaactcctttccttcctaggcatggttagtgaggtcagaattcttacacaagagccaggaccgcaccttgtagcctttctgtccaaacaacttgaccttactgttttagcctagccctcaagtctgcgtgcagcggctgccgctgctttaatacttttagaggccctaaaaataacaaactatgctcaactcactctctacatttctcataacttccaaaattattttcttcctcatacctgatgcatatactttctgctccctggctccttcagctgtactcactctttgttaagtcccacaattaccattgttcctggcccggacctcaatctggcctcccacattattcctgataccacacctgacccccatgactgtatctctctgatccacctgatgttcttcccatttccccacatttccttctttcctgtttctcaccctgatcacgcttgatttattgatggcagttccagcaggcctaatcaccacacagcagcaaaagcaggctatgctatagtacaagccactagcccgcctcttagaacctcatttcctttccattgtggaaatctatcctcaaggaaataacttctcagtgttccatctgctattctgctactcctcaaggattcttcaggccccctcccttccctacacatcaagctcaaggatttgcccccgcccaggactggcaagttagctttactcaacatgcaccgagtcacaaaaactaaaatacctcttagtctaggtagacactttcactggataggtagaggcctttcctacagggtctgagaaggccacacagtcatttcttcccttctgtcagacataattcctcagtttagccttcccacctctatacagtctgataacagaccagcccttattagtcaaatcagccaagcagtttctcaggctcttagtattcagtgaaacctttatatcccttacggtcctccgtcttcaggaaaagtagaacggactaaaggtcttttaaaaacacttcaccaagctcagccaccaacttaaaaaggactggacaatacttttaccactttcccttctcagaagtcagacctgtcctcagaatgctacaaggtacagcccatttgagctcctgtatagacgttcctttttatttggtcccagtctcattccagacaccagaccaacttagactgtgccccaaaaaacttgtcatccctactatcttctgtctagtcatactcctattcaccattctcaactactcatgcattccctgctcttgtttacactgctggtttacactatttctccaagccatcacagctgatatctcctggtgctatccccaaactgccactcttaactcttgaagtaaataaataatctttgctggcaaggctatgctgaatctccttaggtactctaattagatgtcctaggtcctcccaattcttagacctttaatacctgtttttctccttctcttattccgtttagtttttcaattcatacaaaaccgtatccaggccatcaccaataattctaaatgacaaatgtttcttctaatagtcccacagtatcaccccttaccacaaaatcttccttcagcttaatctctcccactctaggttcccacgccgcccctaatcccgctcgaagcagccctgagaaacatcacccattatctctccacaccacccccaaaaattttcaccgtcccaacactttaccactatttcattttatttttcttattaatataagaagacaggaatgtcaggcctctgagccgaagctaagccatcatatcccctgtgacctgcacgtacacatccagatggccggttcctgcctcaactgatgacattccaccacaaaagaagtgaaaatggcctgctcccgccttaactgatgacattgtcttgtgaaattccttctcctggctcattctggctcaaaagctcccctgctgagcaccttgtgacccccactctgcccaccagagaacaaaccccctttgactgtaattttcctttatccacccaaatcctataaaatggccccacccttatctcccttcgctgactctcttttcggactcagcccacctgcacccaggtgaaataaacagccatgttgctcacccaaagcctgtttggtggtctcttcacacggacgtgcatgaaa

SEQ ID NO: 55 - DNA, 5745 bp, Homo sapiens
gtcaggcctctgagcccagctaagccatcatatcccctgtgacctgcacatacacacctagatggccagttcctgccttaaccaatgacagtccaccacaaaagaagtgaaaatggcctgttcctgccttaactgatgacattatcttgtgaaattccttctcctggctcatcctggctcaaaacgtcccctgctgagcaccttgtgaccccccactcctgcctgccagagaacaaccccacttcttcctttacctacccaaatcttataaaatggccccaccctatctccctttgctgactgtctttcggactcagcccggttgcacccaggtgaaataaacagccttgttgctcacacaaagccggtttggcggtctcttcacacagacgtccatgaaatttggtgccgtgactcggatcgggggacctcccttgggagatcaatcccctgctctcctgctctttgctccgtgagaaagatccacctatgacctcaggtcctcagaccgaccagcccaaggaacatctcactaatttcaaatctggtaagtggcctctttttactctcttctccaacctccttcactatccctcaacctctttctccttcaatcttggcaccacacttcaatctctcctttctcttaacttcagttcctttccttttctggtagagacaaaggagatgcgttttatccatggacccaaaactccggcgccggtcacggactcaggaaggcaggcttcccttgctgtttaatcattgcgggacgcctctctgattattcacccacgttccattggtgtctgatctccgtggggatgcctgccttgatcattcacccatgttcccttggtggcaagtcaattgcggggacgcctgctttggctgctcacccacattgcagcccagagctgctccccacccccttctccgtgtctctacccttctctttaaacttgcctccttcactataggcaaccttccaccctccattcctcctcctcccttagcctgtattctcaagaacttaaaacctcttcaactcacacctgacctaaaacctaaacaccttattttcttctacaatgacacttgaccccaatacaaactcgacagtagttccaaatagccagaaaatggcacttgctatttttccatcccacaagatctaaataattcttgtcgtaaaataggcaaatggtctgaggtgcctgacgtccaggcattcttttacacattggtccctccctagtctctgttcccaatgcaactcgtcccaaatcttccttctttccctcctgcctgtcccctcagtcccaaccccaagtgtcactgagtctttctaatcttccttttctacagatccatctgacctctccccagctcggcaggccaagctaggtcccaattcttcctcagcctctgctcctccaccctataatccttttatcacctcccctcctcacactcggtctggcttacagtttcattctgtgactagccctcccccacctgcccggcaatttcctcttaaaaaggtggctggagctaaagccataatcaaggttaatgctcctttttctttatcgcaaatcagatagcatttaggctctttttcatcaaatataaaaatccagcccagttcatggcttgtttggcagcaaccctgagatgctttacagccctagaccctaaaaggtcaaaaggccatcttattctcaatatacattttattacccaatccactcccaacattaaataaaactccaaagactaaattccagccctcaaacccctcaacaggacttaattaaccttgcctttgaggtgtacaataatagagtagaggcagccaaatagcaacatattcctgagttgcaattccttgcctccactgtgagacaaaccccagccacatctccagcacacaagaacttccaaacgcctaaaccgcagtggccaggcattcctccagaactgcctcccccaggagcttgctacaagtgccagaaatctggccaccaggccaagggatgcccgcagcccaggattcctcctaagccacatcccatctgtgcaggaccccactggaaatcagactgtccaactcacctggcagccactcccagagcccctggaactctggcccaaggctttctgactgactccttcccagatcttctcggcttagcagctgaagactgacactgcccaatggcctcagaagccccctagaccatcatggatgccgagcttcgaatagctctcacagtggaaactaagtccgtccccttcttaatcaatacggaggctacccactccacattaccttcttttcaagagtctgtttcccttgcctccataactgttgtaggtattgatggccaggcttctaaacctcttaaaactccccaactctggtgccaacttagacaatacctttttaagcactcctttttagttatccccacctgcccagttcccttattaagctgagacattttaactaaattatctgcttccctgactattcctggactacagccacatctcattgccacctttcttcccaatccaaagcctcctttgtgtcctcctcttgtacctgccccccccaccttaacccacaagtataggatacctctactccctccttggtgaccgatcatgcactccttaccatctcattaaaacctaatcacccttaccccgctcaatgccaatatcccatccgcagtgcactttaaaaagattaaagcctgttatcactcgcctgctacagcatggccttttaaagcctataaactctccttacaatttccccattttacctgtcctaaaaccagacaagccttacaagttagtttaggatctgcgccttatcaaccaaattgttttgcctatccatcctgcggtgccaaacccatagactctcctatcctcaatacctccctccacaacccattattctgttctggatctcaaacatgctttctttactattcctttgcactcttcgtcccagcctctctctgctttcacttggactgacccttggactgaccctgacatgcatcacgctcagcaaattacgtgggctgtactgccgcaaagcttcacaaacagtccccattacttcagtcaagcccaaatttcgtcctcatctgttacctatctcggcataatgctcataaaaacacacgtgctctccctgccaatcatgtctgactgatctctcaaaccccaacaccttctacaaaacaactcctttccttcctaggcatggttacatactttcaactttagatacctggttttgccatcctaacaaaaccattatataaactcacaaaaggaaacctagctgaccccatagatcctaaatccttttcccactcctctttccattccttgaagacagctttagagactgcccccaccctagctctccctgactgatcccaacccttttcattacccacagccgaagtgcagggctgtgcagtcagaattcttacacaagaaccgggaccgtgccctgtagcctttttatgcaaacaacttgaccttactgttttgcctagccctcaagtctgcgtgcagtggccgccacgaccctaatactttcagaggcccttaaaatcacaaactatgttcaactcgctctctacagttctcataacttccaaaatctattttcttcctgacacctgacacatatactttctgctccccagctccttcagctgtactcactctttgttgagtctcccacaattatcattgttcctggcccagacttccatccggcctcccacattattcctgataccacacctgacccctatgactgtatctctctgatccacctgacattcaccccatttccccgtatttccttctttcatgttcctcaccctgatcacacttggtttattgatggcagttccaccaggcctaatcgccacacaccagccaaggcaggctatgctatagtagaagccactagcctacctcttagaacctctcatttcctttccatcatggaaatctatcctcaaagaaataacttctcagtgttccatctgctattctactatttctcagggatgattcaggccccctcccttccctacacatcaagctcagggatttgcccccacccaggactagcaaatttgctattctactacttctcagggattattcaggccccctccgtccctacacatcaaactcaaggatttgcccctgcccagaactggcaaattgactttactcaacacgccccgagtcaggaaactaaaatacctcttggtctaggtagacactttcactggataggtagaggcctttcccacagggtctgagaaggccaccatggtcatttcttcccttctgtcagacataattcctcggtttggccttcccacctctatacagtccgatagcagaccggcctttattagtcaaatcagccaagcaggttttcaggctcttggtattcagtgaaacctttatatcccttatggtcctcagtcttcaggaaaggtagaatggactaaaggtcttttaaaaacacacctcaccaagctcagccaccaacttaaaaaggactggacgatacttttaccactttcccttctcagaattcatgcctgtcctcagaatgctacagggtacagcgcatttgagctcctgtatagacgctcctttttattaggccccagtctcattccagacagcagaccaacttggactgtgctccaaaaaacttgtcatccctactatcttctctctagtcatactcctattcaccattctcaactactcatacatgccctgctcttgtttacactgccggcttacactgtttctccaagccatcacagctgatatctcctggtgctatcgccaaaccaccactcttaactcttaaagtaaataaataatctttgctggcaaggctattctgaatctccttaggcattctttaattagatgtcctaggtcctcccaattcttagtcctttaatacctgtttttctccttctcttattccgttcagtttttcaattcatacaaaacagcatccaggccatcaccaataattctacatgacaaatgtctcctctaacaaccccacaatatcaccccttaccacaaaatcttccttcagcttaatctctcccactctaagttcccaagccgcccctaatcctgctcgaagcagccccgagaaacaccgcccgttatctctccataccaccccccaaaattttcgccatcccaacactttaccactatttcattttatttttcttattaatataagaaaacaggaatgtcaggcctctgagcccaagctaagccatcatatcccctgtgacctgcacatacacatccagatggctggttcctgcctttactgatgacattccaccacaaaagaagtgaaaatggcctgttcctgccttaactgatgacattatcttgtgaaattccttctcctggctcaagacctcccctactgagcaccccgtgacaccccccactcctgcctgccagagaacaaccccctttttcctttaaacgcaaatcttatcaaacgggcccacccctatctcccttcgctgactctcttttcggactcggcctgcctgcacccaggtgaaataaacagccttgttgctcacacaaagcctgtttgatggtttcttcacacagacgtgcatgaaa

SEQ ID NO: 56 - DNA, 5823 bp, Homo sapiens
gtcaggcctctgagtccaagccaagccattgcatcccctgtgacttgcacgtatatacccagatggcctgaagtaactgaagaatcacaaaagaagtgaaaagatcctgccccgccttaactgatgacattccaccattgtgatttgttcctgccccaccttaactgagtgattaaccctgtgaatttccttctcctggctcagaagctcccccactgagcaccttgtgacccctgcccctgcccaccagagaacaaccccctttgactgtaattttccattaccttcccaaatcctataaaatggccccaccccatctcccttcgctgactctctttccggactcagcccacctgcacccaggtgaaataaacagctttattgctcacacaaagcctgtttggtggtctcttcacacggatgcgcatgaaatttggtgccgtgactcggatcgggggacctctcttaggagatcaatcccccgtcctcctgctctttgctccatgagaaagatccacctatgacctcaggtcctcagaccgaccagcccaagaaacatctcaccaatttcaaatctggtaagcggcctcttttcactctcttctccaacctccctcactatccctcaacctctttctcctttcaatcttggtgccacacttcaatctctcccttctcttaatttcaattcctttcattttctggtagagacaaaggagacaccttttatccttggacccaaaactccggcgccagtcacagactgggaaggcagccttctcttggtgtttaatcattgcagggacacctctctgattattcacccacgtttcaagggtgtcagaccacgcagggacgcctgccttggtccttcacccttagtggcaagtcctgcttttctggggaaggggcaagtaccccaaccccttctctccttgtctctactccttctctgcttttctggggaaggggcgagtaccccaaccccttctctccttgtctctaccccttctctgcttttctggggaaggggcaagtaccccaaccccttctctccttgtctctaccccttctctgcttttctgggggagggcaagtacccctcaaccccttctccttcacccttagcggcaagtcccactttgctagggggaaagaacccccaatcccttatttccacaccccgacctcttatctctgtgccccaatcccttatttccacaccccgacctcttatctctgtgccccaatcccttatttccgcaccccaacctcttatctctgtgccccaattccttatttccatgccccaacacttcctctgcttttctggagggcaagaaacccctaccccttctccgtgtctctactcttttctctgggcttgcctccttcactatgggcaagcttcaaccttccattcctccttcttctcccttaacctatattcttaagaacttaaaacctcttcaactctcacctgacctaaaatctaagcatctcattttcttctgcaatgccacttgaccccaatacaaactcgatggtagttccaaatagccagaaaatggcactttcaatttttccatcctacaagatctaaataattcttgtcataaaatgggcaaatggtctgaggtgcctgacatccaggcattcttttacacatcagtcccttcctagtctctgtgcccagtgcaactcgtcccaaatcttccttctttccctcctgcctgtccccacagtcccaaccccaagcgtcactgagtctttctaatctcccttttctacagacccatctgacctctcccctcctcaccaggccaagctaggtcccaattcttcctcagcctctgctcctccaccctgtaatctttttatcgcctcccctcctcacacctggtcctgcttgcagttatgttccgtgactagccctcccccacctgctcagcaatttactcttaaaaaggtggctggagccaaaggcatagtcaaggttaatgctcctttttctttatcccaaatcagaagcgtttaggctctttttcatcaaatataaaaacccagaacagttcatggctcgttcggcagcaaccctgagacactttacagccctagaccctaaatggtcaaaaggccatcttattctcaatatacactttattacccaatctgctcccgacattaaataaaactccaaaaattagaatctggccctcataccccacaacaggacttaattaacctcaccttcaaggtgtacaataataataaaaaaaaaaagttgcaattccttgcctccactgtgagacaaaccccagccacatctccagcacacaagaacttccaaacccttgaactgcagcggccaggcgttcctccagaacctcctcccccaggagcttgctacaagtgccagaaatctgaccaccaggccaaggaatgcctgcagcccaggattcctcctaagctgtgtcccatctgtgcgggaccccactggaaatcggactgttcaactcacctggcagccactcccagagcccctggaactctggcccaaggctctctgactgactccttcttggcttagcggctgaagactgatgctgcctgattgcctcggaagccctgtagaccatcacagatgccgagctttaggtaactctcacagtggagggtaagtccgtccccttctaaatcaatacggaggctactcactccacattaccttcttttcaaggacctgtttcccttgcctccataactattgtgggtattgatagccaggcttctaaacctcttaaaactccccaactctggtgccaacttagacaatacgcttttatgcactcttttttagttatccccacctgcccagttcccttattaggccgagatattttaaccaaattatctgcttccctgactattcctggactatagctgcatctcattgccgcccttcttcccaatccaaaacctcctttgtgtcctcttcttgtattcccccaccttaacccacaagtataagatacctctactccctccttggcgaccaatcatgcacccttaccatctcattaaaacctaatcacccttaccccactcaatgccaatatcccatcccacagcatgctttcaaaggattaaagcctgttatcactcgcctgctacagcatggccttttaaagcctataaactctcccacaattcccccattttacctgtcctaaaaccagacaagccttacatgttagttcaggatctatgccttatcaaccaaattgttttgcctatccaccccatggtgccaaacccatatactctcctattctcaatacctccttccacaatccattattctgttctggatctcaaagatgctttctttactattcctttgcacccgtcatcccagcctctctttgctttcacttggactgaccctgacacccatcaggctcagcaaattacctgggctgtactgccacaaggcttcacagacagaccccattacttcagtcaggcccaaatttcgtcctcatctgttacctatctcaacataattctcgtaaaaacacatgtgctctccctgctgatcgtgtctgattaatctcccaaacctcaatcccttacaaaacaacaactcctttctttcctaggcatggttagtgcggtcagaattcttacacaagagccaggaccgcaccctgtagcctttctgtgcaaacaacttgaccttactgttttagcctagccttcatgtctgcgtgcagcggctgctgctgctttaatacctttagaggccctcaaactcacaaactgtgctcaactcactctctacatttctcataacttccaaaatctattttcttcctcatacctgatgcatatactttctgctccctggctccttcagctgtactcactcttcattaagacccacaattaccattgttcctggccgggacttcaatccggcctcccacattattcctgataccacacctgacccccatgactgcatctctctgatccacctgatgttcatcccatttccccacatttccttcttccctgtttctcaccctgatcatgcttgatttattgatggcagttccaccaggcctaatcaccacataccagcaaaggcaggctatgctattgtataagccactagcccgcctcttagaacctttcattttctttccatcgtagaaatctatcctcaaggaaataacttcttagtgttccatctgttattctgtctgctattctactacacctcaaggattattcaggccccctcccttccctacacatcaagctcaaggatttgcccccacccaggactggcaaattagctttactccacatgccctgagtcacaaaaactaaaatacctcttagtctaagtagacactttcactagataggtagaggtctttcctacagggtctgagaagtccaccgcagtcatttcttcccttctgtcagacataattcctcagtttagccttcccacctctatacagtctgataacaggccagcctttattagtcaaatcagccaagcattttttcaggctcttagtattcagtgacagactaatggtctattaaaaacacacctcaccaagctcagccaccaacttaaaaaaggactggacaatacttttaccactttcccttctcagaagtcaggcctgtcctcagaatgctacaaggtacagcccatttgagctcctgtatagacgttcctttttattaggccccagtctcattccagacaccagacaaacttagactgtgcccccaaataacttgtcatccctactatcttctgtctagtcatactcctattcaccattctcaactactcatacatgccctgctcttgtttacactgccagtttacactgtttctccaagccgtcacagctgatatctcctcgtgctatccccaaactgccactcttaactcttgaagtaaataaataatctttgctggcaggactatgctgaccctccgtaggcactctctaattagatgtcctaggtcctcccaattcttagtccttttatacctgtttttctccttctcttattccatttagtttttcaattcatacaaaaccgtatccaggccatcaccaatcattctatatgataaatgtttcttctaacaaccccacagtatcaccccttaccacaaaatcttccttcagcttaatctctcccactctaggttcccacaccacccctaatcccgcttgaagcagccgtgagaaacatggcccattctctctccataccacccccaaaaattttcgccgccccaacacttcaacactattttatttttcttattaatataagaaggcaggaatgtcaggcctctgagcccaagccaagccattgcatcccctgtgacttacatgtatatgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctcccccactgagcaccttgtgacccccacccctgcccaccagagaaaaaccccctttgactgtaattttccattaccttcccaaatcctctaaaacagccccacccctatctccctttgctgactctcttttcagactcagcccacctgcacccaggtgaaataaacagctttattgctcacacaaagcctatttggtggtctcttcacacggacgcgcatgaaa

SEQ ID NO: 57 - DNA, 321 bp, Homo sapiens
taggtcaggcacaaataagcccaccctactaggaactatgttgaaaaatttcaaaaaagaatttaaaggagactatggagtactgtgacactaggaaaacttaaaactttgtgtaagatagactggccagcattagaggtaagttggccattagaaggaagcctggacaggtcccttgtttcaaaggtgtggcccaaggtaacctgtaagccagggaatgcagaccagttcctgtacatagacacttggttacagctggttttagaccccccgcccccaacacacagtggttgagagaacagcagcataagtggctggcag

SEQ ID NO: 58 - DNA, 6028 bp, Homo sapiens
gtcaggcctctgagcccaagccaagccatcgcatcccctgtgacttgcacatatacgcccagatggcctgaagtaactgaagaatcacaaaagaagagaaaaggccctgccctgccttaactgatgacattccaccattgtgatttgttcctgccccaccattaaccctgtgaatttccttctcctggctcagaagctccccaactgagcaccttgtgacccctacccctgcccaccagaaaacaaccccctttgactgtaattttccattaccttcccaaatcctataaaacggccccacccctatctcccttcgctgactctctttttggactcagcccgcctgcacccaggtgaaataaacagccatgttgctcacacaaagcctgtttggtggtctcttcacatggacgcgcatgaaatttggtgctgtgactcgaattgggggacctcccttgggagatcaatccgctgtactcctgttctttgctccgtgagaaagatccacctatgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtgcacccaaaactctggcgccggtcacggactgggaaggcagccttcccttggtgtttaaacattgcagggacgcctctctgattatacacccacgtttcaaaggtgtcagatcacgcagggacgcctgccttggtccttcacccttagtggcaagtcctgcttttctggggaaggggcaagtaccccaaccccttctctccttgtctctaccccttctctgcttttctgggggaggggcaagtacccctcaactccttctccttcacccttagcggcaagtcccgcttttctgggagaggggcaagtacccctcaaccccttctccttcacccttagtggcaagtcccgcttttctgggggaggggcaagtacccctcaaccccttctccttcacccttagtggcaagtcccgcttttctgggggaggggcaagtacccctcaaccccttctccttcactcttagcggcaagtcctgcttttctagaggaggggcaagtaccccaacctcgtatctctgcgccccaatcccttatttccacgcccctacctcttatctctgcgccccaatcccttatttctgtgccccgaccccttatttccatgccccaaccccttatttctgtgccccatcccttatttccgtgccccgacctcttatctctgcgccccaaccccttttcccacttttctggaaggtaagaaccgccgaaccccttctctctgtttctctactctctcttttctctaggcttgcttccttcactatgggcaaccttccaccctccattcctccttctactcccttggcctgtgttctcaaaaacttaaaacctcttcaactcacacctgacctaaaacctaaatgccttattttcttctgcaatgccacttgaccccaatacaaactcaacagtagttccaaatagccagaaaatggcactttgaatttctccatcctgcaagatctaaataattcttgtcgtaaaataggcaaatggtctgaggtgcctgacgtccaggcattcttttacacatcagtcccttcctagcctctgtgcccagtgcaactcgtcccaaatcttccttctttccctcccgcctgtcccctcagtaccaaccccaagcgtcgctgagtctttctaatcttcattttctacagacccatctgacctctcccttcctccccaggctgctcctcgccaggccgagctaggtcccaattcttcctcagcctctgcttctccaccctataatccttttatcacctcccctcctcacacctggtccggcttacagtttccttccgtgactagccctcccccacctgcccagcaatttactcttaaaaaggtggctggagctaaaggcatagtcaaggttaatgctcctttttctttatcccaaatcagatagcatttaggctctttttcatcaaatataaaaacccagcccagttcatggctcgtttggcagcaaccctgagacgctttacagccctggaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccacaggagcttgctacatatgctggaaatctggccactgggccaaggaatgcccgcagcccgggattcctcctaagccgcatcccatctgtgtgggaccccactgaaaatcggactgttcaactcacctggcagccactcccagagcccctggaactctggcccaaggctctctgactgactccttcccagatcttctcggcttagcggctgaagaccgacactgcccgatcacctcggaagccccctagaccatcacggacgccaagcttcaggtaactcacagtggaaggtaaggccgtccccttcttaatctatacggaggctacccactccacattaccttcttttcaagggcctgtttcccttgcctccataactgttatgggtattgacagccaggcttctaaacctcttaaaactccccaactctggtgccaacttagacaatacccttttaagcactcctttttagttatccccacctgcccagttcccttattaggctgacgctttaactaaattatctgcttccctgactattcctggactacagctatatctcattgccgcccttcttcccaatccaaagcttcctttgcgtcctcctcttgtatccccccaccttaacccacaagtataagatacctctactccctccttgcacctcttaccatctcattaaaacctaattacccttaccccactcaacgccaatatcccatcctgcagcacgctttaaaaagattaaagcctgttatcactcgcctgctacagcatggccttttaaagcctataaactctcgttacaattcccccattttacctgtcctagaaccagacaagccttacaagttagttcaggatctgcgccttatcaaccaaattgttttgcctatccaccccgtggtgccaaacccatatactctcctatcctcaatacctgcctctacaacccattattctgttctggatctcaaacatgctttctttactattcctttgcacccttcatcccagcctctctttgctttcacttggactgaccctgacacccatcaagctcagcaagttacctaggctctactgccacaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcagtcagaattcttacataagagccaggaccacaccgtgtagcctttctgtccaaacaacttgaccttactgttttagcctagccctcatgtctgcgtgcagcggctgccgctgctttaatactgttagaggccctaaaaatcacaaactatgctcaactcactctctacatttctcatagcttccaaaatctattttcttcctcatacctgatgcatatactttctgctccccggctccttcagctgtgctcgctctttaagtcccacaatgaccattgttcctggtccggacttcaatctggcctcccacattattcctgataccacacctgacccccatgactgtatttctctgatccacctgatattcaccccatttccccatatttcattctttcctgttcctcaccctgataacgcttgatttattgacggcagttccaccaggcctaattgccacacaccagcaaaggcaggctatgctatagtacaagccactagcccgcctctcagaacctctcatttcctttccattgtggaaatctatcctcaaggaaataacttctcagtgttccatctgctattctactactcctcagggattattcaggccccctcccttccctacacatcaagctcgaggatttgtccccacccaggactggcaaattagctttactcaacatgtcccgagtcaggaaactaaaatacctcttagtctaaatagacactttcactgaataagtaaaggcctttcctacagggtctgagaaggccaccacagtcatctcttcccttctgtcagacataattcctcagtttagccttcccacctctatacagtctgataacagaccagcctttattagtcaaatcagccaagcagtttttcaggctgttagtattcagtgaaacctttatatcccttacggtcctccgtcttcaagaaaagtagaacggactaaaggtcttttaaaaacacacctcaccaagctcagctaccaacttaaaaaggactggacaatacttttaccactttcgcttctcagaattcaggcctgtcctcagaatgctacaaggtacagccaatttaagctcctgtatagacgctcctttttattaggccccagtctcattcgacaccagaccaacttagactgtgccccaaaaaaacttgtcatccctactatcttctgtctagtcatactcctattcaccgttctcaactactcatacatgccctgctcttgtttacactgccggtttacactgtttctccaagccatcatagctgatatctcctggtgctatccccaaactgccacacttaactcctgaagtaaacaaacaatcttggctggcaggactatgctgaatctccttaggcactctctaatcagatgtcctaggtcctcccaattcttagaccttttatacctgtttttctccttcttttattccatttagtttttcaattcatacaaaactgtatccaggccatcaccaatcattctataagacaaatgtttcttctaacaaccccacaatatcaccccttaccacaaaatcttccttcagcttaatctctcccactctaggttcccacgccgcccctaatcccgctcgaagcagccctgagaaacatcgtccattctctctccataccacccccaaaaattttcgccgccccaatacttcaacactattttgttttatttttcttattaatataagaaggcaggaatgtcaggcctctgagcccaagccaagccatcgcatcccctgtgacttgcacgtatacgcccagatggcctcaagtaactgaagaatcacaaaagaagtgaaaaggccctgccccgccttaactgatgacattccaccattgtcatttgttcctgccccaccttaactgagtgattaaccctgtgaatttccttctcctggctcagaagctcccccactgagcaccttgtgacccctacccctgcccaccagagaacaaccccctttgactgtaattttccattaccttcccaaatcctataaaacggccccaccccatctcccttcactgactctcttttcggactcagcccgcctgcacccaggtgaaataaacagccatgttgctcacacaaagcctgtttggtggtctcttcacatggacgcgcatgaaa

SEQ ID NO: 59 - DNA, 5781 bp, Homo sapiens
gtcaggcctctgagcccaagctaagccatcatatcccctgtgtcctgcacgtacacatctagatggccggttcctgccttaactgatgacattatcttgtgaaattccttatcctggctcttcctggctcaaaagctcccctactgagcaccttgtgacccccactcctgcctgccagagaacaacccacctttgactgtaattttcctttacctacacaaatcttataaaatggcgccacccctatcgccctttgctctcttttcagactcagcccacctgcacccaggtgattaaaaagctttattgctcacacaaagcctgttggtgggctcttcacatggacacgagtgaaatttggtgccatgactcggatcaggggacctcccttgggagatcaatcacctgtcctcctgctctttgctccatgagaaagatccacctatgacctctggtcctcagaccaaccagcccaaggaacacctcaccaattttaaatctggtaagtggcctctttttactctcttctttaacctctctcactatccctcaacctctttctcctttcaatcttggtgccacactttgatctctcccttctcttaatttcagctcctttccttttctggtagagatggcgacgcgttttgtttgtggacccaaaactccgacacccgtcatggactcgggaagacagtcttcctttgttgtttaatcatgcgaggatgcctgcctgattattcacccacgtttcagaagtgtctgaccacacggggatgcctgccttggtccttcacccttagcaacaagtaccactttaatggggggcaagaaacccccaaccccttctctccatgtctctaccccttctctgcttttctagggggcaagaaccccccaaccccttctccttcacccttagtggcaagtaccacttttctagggggcaagaacaccccaaccccttctctccatgtctctaccccttctctgcttttctgggggacaggaaccccccaccccttctctccatgtctctactctctcttttctctgggcttgcctccttcactatgggcaagcttccgccctccattcccccttcttctcccttagcctgtattcttaaaaacctaaaacctcttcaactcacacctgaccaaaaacctaagtgccttattttcttctgcaatgctgcttgaccccaatacaaacttgacagtagttccaaatagccagaaaatggcactttcaatttttccatcctacaatatctaaataattcttgtcataaaatgggcaaacagtctgagatgcctgatgtccaggcattcttttacacatcagtccctccctagtctctgttcccaatgcaactcatcccaaatcttccctctttccctcccatctgtcccctcagtcccaacctcaagcatcgcagagtctttctaatcttccttttctacagacccatctgacctctcccctccttgccaggctgagctagttcccaattcttcctcagtctctgctcctccaccctataatccttttatcaccttcactcctcacacagggtccagcttacagtttcgttgtgactagccctccccaacctgcccagcaatttcctcttaaagaggtggctggagctaaaggcatagtcaaggttaatgctcctttttctttatcccaaatcagacagcatttaggctcttctccatcaaatgtaaaaacccagcccagttcatggctcatttggcaacaaccctgagatgctttacagccctagtccctaaaaggtcaaaaggctgtcttattctcaatatacattttattacccaatcggctcctgacattaaataaaactacaaaaattaaattctggccctcaaaccccacaacaggacttaactaacctcaccttcaaggtgtacaataatggagtagacacagccaagtagtaacatatttctgagttgcaattccttgcctccattgtgagacaaaccccagccacatctccagcacacaagaacttccaaatgcctaaaccacagtggccaggcattcctccaggcctgcctccctcaggagcttgctacgagtgccagaaatctggccaccagaccaaggaatgcccgcagtccaggattcctcttaagccatgtcccatcaatgtgggaccccactgaaaatcggactgttcaactcacctggcagccactcccagagcccctggaactctggcccaaggctgtccgactgactccttcccagatctttttggcttagtggctcaactctgatgctgcccgatcacaatagaagccccctagaccatcacggatgccaagcttcaggtaactttcacagtggtaggtaagtccatccccttcttaatcaatatggagactacccactccacattactttcttttcaagggcctgtttcctttgcctccataactgttgtaggtattgacgaccaggcttctaaacctcttaaaactccccaactctggtgccaacttagacaatactctttaaagcactcctttttagttatcaccacctgtccagctcccttattaggtcgagacattttaactaaattatctgcttccctgactattcctgggctacagccacacctcattgccaccttttaccccagttcaaagcctccttcacatcctctccttgtatctccccactttaaaccacaagtataggacacctctacatcctccttagcgacccatcatgcacctcttaccatctcattaaaacctaatcacccttaccccactcaatgccaatatcccatcccacagcatgctttaaaaggattaaagcctgttatcattcgcctgttacagcatggccttttaaagcctataaactctccttacaattcccccattttacctgtccaaaaaccggacaagccttacaggttagttcaggatctgagccttatcaaccaaattgttttgcctatccaccccatggtaccaaccccatatactctcctatcctaaatacctccctccacaaacccattattttattctggatctcaaacatgctttctttactattcctttgcaccattcaccccagcctctcttcgctttcacttaactgaccctgacacccatcaggctcagcaaattacctgggctgtactgccacaaggcttcacagacagcccccattacttcagtcaagcccaaatttcttcctcatctgttacctatcactgcataattctcataaaaacacatgtgctctccctgctgatggtgtccagctaatctcccaaatcccaatcccttctacaacatagcaactcctttccttcctaggcatggttagtgtggtcagaattcttacacaagagccaggactgcaccctgtagcctttctgtccaaacaacttaacctcattgttttagcttagccctcatgtctgtgtgcagtggctgccactgccttaataattttagaggccctcaaaatcacaaactatgctcaactcactctacagttctcataacttccaaaatctattttcttcctcacacctgatgcatatactttctgccccactccactaactctcagaaagtcgaactcattgccttaactcgagcactcactcttgcaaaaggactacacatcaatatttgtactgactctaaatatgccttccatatcttgcaccaccatgctgttatataggctgaaagagatttcctcaccacctttgcatagtggcaaagtcctccatcattaatgcctctttaataaacactctactcaaggctgctttacttccaaaggaaaccgaagtcattcactgcaagggccatcaaaaggcattgctctaagcaaggcttatgctgataaagtggctagacaagcagctagcttccaacttctgtccctcacggccagtttttctccttcacatcggtcactcccacctactcccctgctgaaacttccacctatcaatctcttcctacacaaggcaaatggttcttaggccaaggaaaatatctccttccagcctcacaggcccattctattctgtcatcatttcataacctcttccatgtaggaagctgctagcctgtctcttagaacctctcatttcctttccatcctggaaatttattctcaaggaaatcacttctcagtgttccatctgctagtctactaccactcagggattgttcaggcctcctccctttcctatacatcaagctcggggatttgcccctgcctgggactggcaaattgactttactcacatgccctgagtcagaaaactaaaatctggatagacactttcactggatgggtagaggcctttcctacagggtctgagaaggccaccacagtcatttcttcccttctgtcagacataattctttggtttggccttcccacctctatacagtctgagagcagactgacctttattagtcaaatcagccaagcattttttcaggctcttggtattcagtgaaacctttatatcccttacggtctgcagtcttcaggaaaggtagaacgaactaatggtcttttaaaaacacacctcaccaagctcaaccaccaacttaaaaaggactggacaatacttttaccactttcccttctcagaattcaggcctgtcctcagaatgctacagggtacagcccattcgagctcctgtatagacactcctttttattggccccagtctcattccagacaccagaccaacttagactgtgccccaaaaaacttgtcttccctactatcttctgtctagtcacactcctattcaccgttctcaactactcatacatgccctgctcttgtttacactgccagtttacactgtttcttcaagccatcacagctgatatctcctggtgctatcctcaaactgccactcttaactcttaaagtaaataaataatctttgctggcaggactatgctgaatctccttaggcactctctaattagatgtcctgggtcctcccggttctcagacctttaatacctgtttttctccttctcttattccgtttagtttttcaattcagacaaaaccttatccaggccatcatcaataattctaaatgactaatgtttcttctaacaaccccacaatatgaccccttaccacaaaatcttccttcaccttaatctctcccactctaggttcccacgccgccccaatcccactcaaagcggccctgagaaacattgcccattatctctccataccacctgcaaaaatttttaccgtccaacactttaccatgatttcattttatttttcttattaatataagaagacaggaatgtcaggcccctgagccgaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcattctggctcaaaagctcccctactgagcaccttgtgacccccactcctgcctgtcagagaacaacccccctttgactgtaattttcctttacctactcaaatcttataaaatagccccaccccatctcccttctctgactctcttttcagactcaacccgcctgtgcccaggtgattaaaaagtgtattgctcacacaaagtctgtttggtggtctcttcacacagacgcgagtgaaa

SEQ ID NO: 60 - DNA, 2376 bp, Homo sapiens
acaacttgaccttactgttttaggctggccatcatgtccccgtgcagcagctgccgctgccctaacacttttagaggccctcaaaatcacaaactatgctcaactcactctctatagttctcataacttccaaaatctattttcttcctcacacctgatgcatatactttctgctccccggctccttcagctgtactcactctttgttgagtctcccacagttaccattgttcctggcccggacttcaatccagcctcccacactattccggatacatctgactcccatgactgtatctctctgatccacatgacattcactccctttctccatgtttccttctttcctgttcctcaccctgatcacacttggtttattgatggcagttccaccaggcctaatcgccactcaccagcaaaggcaggctatgctatagtatcttccacatctatcactgaggctaccgctctgcccccctccattacctctcagcaagctgaactcactgccttaacttgagccctcactcttgcaaagggactacccatcaatatttatactgactctaaatatgccttccatatcctgcaccaccatgctgttatataggcagaaagaagtttcctcactatgcaagagtcctccatcaataatgcctctttaataagaactcttctcaaggctgctttacttccaaagaaagccggagtcattcactgcaaaggccatcaaaaggcttcagatcccattgctctggacaacgcctatgctgataagatagctaaaaaagcagctagcgttccaacttctatccctcagggcagttttcctccttctcatctggccactcccacctactccctcgctgaaacttccacccatctcttcccacacaaagcaaatggttcttggaccaaagaaaaatctccttccagtctcacaggcccattctattcgtcatttcataacctcttccatgtaggttgcaagccgctagcccgcctcttagaacccgctagcccacctcttagaacctctcatttcctttccatcgcaaaaatctatcctcaaggaaatcacttttcagtgttccatctgctattctactactcctcaagaatttctcaggccccctcccttccccacacatcaagctcggggatttgccccgcccaggactggcaaattgactttactcacatgcctcgagtcaggaaactaaaatacctcttggtctgggtagacactttcactggatgggtagaggcctttcccacagggtctaagaaggccaccgtggtcatttattcccttctgtcagacatagttcctcggtttggccttctcacctctatacagtccgataacggaccggcctttactagtcaaatcacccaagcagtttctcaggctgttggtattcagtggcacctggtttttcctcaaactgccacccttaagtctctctttaagtggatagaagatcttcagtggcaaggtaccctccaatactttcaccctgatgaagtcctattctttacttttatacttactcttattctcattcccgttcttatgccaccctctacctctccccagctatctctatcacactatcaatctcagttactctctcctagccgtttctaatccttctttaacaaacaattgctggctttgcatttctctttcttccaaaatcacaaaggtctcgacttactgctaaaaaaaaaaaaaaggggactctatatttttaaatgaagagtgctatttttacctaaatcaatctggcctggtatatgacaacattaaaaaaaactcaaagatagagcctaaaagcttgccaaccaagcaagtaattacactaaccccccttggacactctaattagatgtcctgggtcctcccaattcttagtccttttatacctgtttttctccttctcttattcagaccttgtgtcttccatttagtttctcaattcatccaaaaccatatccaggccatcaccaatcattctatacgacaaatgtttcttctaacaacccgacaattatcaccccttaccacaaaatcttccttcagcttcatctctcccacactaggtttccatgttgccccagtcctgctcaaagcagccctgagaaacattgcccattatctctccataccaccccccaaaattttccccaccccaacactttaccactattttatttttcttattaatataagaagacaggaatgtcaggcctctgagcccaagctaagccatcatatccccagtgacctgcacgtatacatccagatggcctgaagcaactgaagatacacaaaagaagtgaaaatagccttaactgataacattccaccat

SEQ ID NO: 61 - DNA, 2178 bp, Homo sapiens
tgactctctttttggactcagctcgcctgcacccaggtgattaaaaagctttattgctcacacaaagcctgtttggtggtctcttcacatggacgtgagtgaaatttggtgccatgactcagatcgggggacctcccttgggagatcaatcccctgtcctcctgctctttgttctgtgagaaagatccacctacgacctctggtccccagaccaactagcccaaggaacatctcaccaattttaaatccagtaagtggcctctttttactctcttctacaacctctctcactatccctcaacctctttctcctttaaatcttggcgtcacacttcagtctctcccttctcttaatttcagttcctttccttttctggtagagatgaaggagacacgttttatccgtggacccaaaactccggcgccagtcaaggactggggaagacagtcttctcttggtgtttaatcacgcggagacgcctgcctgattattcacctaagtttcagaggtgtctgaccatgcagggacgcctgccttggtccgtcacccttagcagcaagtaccgcttttctggggggcaagaaccccccaaccccttctctccgtgtctctaccccttctccacttttctggcgggcaagaaccccccaaccccttctccttcacccttagcagcaagtaccacttttctagggggcaagaacccctcaaccccttctccttcactcttagtggcaagtactgcttttctagggggcaggaaccccccgaccccttctctctgtctttaccccttctctgcttttctgggggtcaagaaccccccaccccttctctccgtgtctctactctctcttttctctgggcttgcctccttcactatgggcaagcttccaccctccattcccccttcttctcccttagcctgtgttcttaaaaacctaaaacctcttcaacaaacacctgacctaaaacctaaatgccttatttccttctgcaatgccacttgacccaatacaaactcaacagtggttccaaatagcgagaaaatagcactttcaatttttccatcctatgagatctaaataattcttgccgtaaaataggcaaacggtctgaggtgcctgacgtccaggcattcttttacacgtcggtccctccctagtttctgttcccaatgcaacttgtcccaaatcttccttctttctctcccgcctgtccccttagtcccaaccccaagcatcgctgagtctttctaatattccttttctacagacccatctgacctctcccctcctcgccaggctgagctaggtcccaattcttcctcagcctctgctcctccaccctattatcctttttatcacctcccctcctcacaccaggtccggctcacagtttcgttctgagactagccctcccccacctgcccagcaatttcctcttaaaaaggtggctggagctaaaggcacaatcaaggttaatgctcctttttctttatcccaaattagagagcatttaggctctttttcaacagatataagaacccagcccagttcatggctcatttagcagcaaccctgagacgctttacagccctagaccctaaaaggtcaaaaggacgtcttattctcaatatacattttattatccaatctgctcccgacattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccacacacaaaaacttccaaatgcctaaaccacagtggccaggcattccttcaggcccgcctcccccagaagcttgctacaagtgccagaaatctggccaccaggccaaggaatgcccacagcccagaattcctcctaagctgcgtccaatctgtgcaggaccccactgaaaatcggacagttcaactcacctggcagccactcgcagagcccctggctctctgactgactccttcccagatcttctcggcttagtggctgaagactgacactgcccgatcaccttggaagccccctagaccatcacagacgccgagtttcaggtaactctcacagtgaaagg

SEQ ID NO: 62 - DNA, 3859 bp, Homo sapiens
gtcaggcctctgagcccaagccaagccatcacatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttgtaattctccccacccttgagaatgtactttgtgagagccacccctgcccacaaaacattgctcttaacttcactgcctatcccaaaacctataagaactaatgacaatccaccaccctttgctgactctctttttggactcagcccacctgcacccaggtgaaatacacagctttattcctcacacaaagcctgtttggtggtctcttcacacggacgcgcatgaaatttggtgtcgtgactcggatcaggggacctcccttggcagatcaatcccctgtcctcctgctctttgctccatgagaaagatccacctatgacctcaggtcctcagaccaaccagcccaagaaacatctcaccaatttcaaatccggtaagcggcctccttttactctcttctccaacttccctcactatccctcaacctctttctcctttcaatcttggcgccacacttcaatctctcccttctcttaattttaattcctttcattttctggtagagacaaaggagacacgttttatacgtggacccaaaactgtggtgccggtcacagactgggaaggcagccttcccttggtgtttaatcactgcagggacgcctctctgattattcacccacgtttcaagggtgtcagaccacgcagggacgcctgccttggtccttcacccttagcagcaagtcccgcttttctggggaaagggcaagtaccgcaaccccttctctccttgtctctatcccttctctgcttttctggggaaagggcaagtaccccaaccccttctctccttgtctctatcccttctctgcttttctgggagaggggcaagtacccctcaaccccttctccttcaccctcagcggcaagtcccgcttttctgggggaggggcaagtaccccaaccccttctctccttgtctctaccccttctctgcttttctggggaaagggcaagtaccccaaccccttctctccttgtctctaccccttctctgcttttctggggaaagggcaagtaccccaaccccttctctccttgtctctatcccttctctgcttttctgggagaggggcaagtacccctcaaccccttctccttcaccctcagcggcaagtcccgcttttctgggggaggggcaagtacccctcaaccccttctccttcacgcttagcggcaagtcccgcttttctagggggcaagaacccccaatcccttatttccacaccccgacctcttatctctgtgccccaatcccttatttctgtgccccaaccccccttcccacttttctggagggtaagaaccccaaaccccttccctccatgtctctacactctcttttctctgggtttgcctccttcactatgggcaaccttccaccctccattcctccttcttctcccttagcctgtgtcctcaagaacttaaaacctcttcaactcacacctgacctaaaacctaaatgccttattttcttctgcaacactgcttggccccaatacaaacttgacaatggctctaaatggccagaaaacagcactttcaatttctccatcctacaagacctaaataatttttgtcaaaaaatgggcaaatggtctgaggtgccttatgtccaggcatttttcacacttcattccctccctagcctctgttcccaatgcgattcctcccagatcctccttctttccctcccgcctgtcccctcagtctcaaccccaagtgtcgctgagtctttccagtcttccttttctacagacccatctgacctttcccctcctccccaggctgctcatcagcaggctgagctaagtcccaattcttcctcagcctccactcctccaccctataatccttctatcacctcccctcctcacacctggtccggcttacagtttagttccgtgactagctcttccccacctgcccagcaatttactcttaaaaaggtggctggagctaaaggcatagtcaaggttaatgctcctttttctttatcccaaatcagatagcgtttaggctctttttcatcaaatataaaaacccagcccagttcatggctcgttcggcagcaaccctgagacactttacagccctagaccctaaaaggtcaaaaggctgtcttattctcaaaatacattttattacccaatctgctcccaacattaaataaaactccaaaaattaaattccagccctcaaaccccacaacaggatttaattaacctcgccttcaagatgtacaataatagaaaaaagttgcaattccttgtctccactgtgagacaaaccccagccacatctccagcacacaagaacttccaaacacctgaaccgcagctgccaggcgttcctccagaacctcctccccaggagcttgctacaagtgccaaaaatctggccaccaagccaaggaatgccgacagcccaggattcctcctaagctgtgtcccgtctgtgcgggaccccactgaaaatcggactgttcaactcacctggtagccacttccagagcccctggaactctggcccaaggctctctgattccttcccagatcttcttagcttagtggctgaagactgacgctgcccaatcgcctcggaagcgccgtagaccatcacggatgccgagcttcaggtaactctcacagtggaaggtaagtctgtccccttcttaatcaatacggaggctacccactctatattaccttcttttcaagggcctgtttcccttgcctccataactgttatgggtattgatggccaggcttctaaacctcttaaaactccccaactctggtgccaacttagacaacactgttttatgcactcttttttagttatccccacctgcccagttcccttattaggctgagacactttaactaaattatctgcttccctgactattcctggactacagccacatctcattgccacccttcttcccaatccaaagcctccttcgcgtcttcctctcgtatccccccaccttaacccacaagtatgggacatctctactccttccctggcaactgatcacatgcccattaccatcccattaaaacctaatcacccttaccccactcaacgccaatatcccatcccacagcacgctttaaaaggattaaagcctgttatcactcgcctgctacagcatgggcttctaaaacctataaactctccttaccattcccccattttacctgtcctaaaaccagacaaggcttacaagttagttcagaatctgcaccttatcaaccaaattgttttcctatccaccccgtggtgccaaacccatatactctcctatcctcaatacctccctctactacccattattctgttctggatctcaaacatgctttctttactgttcctttgcacccttcatcccagcctctctttgccttcacttagactgaccctgacacccattagactcagcaaattacctgggctgtactgccgcaaggcttcagagacagtccccattacttcagtcaagcccaaatttcaacctcatctgttacctatctcagcataattctcataaaaacacatgtgctctctctgcttatcgtgtcggattaatctcccaaacctcaatctcttacaaaagaacaactcctttccttcctaggcgtggttag

SEQ ID NO: 63 - DNA, 5863 bp, Homo sapiens
gtcaggcctctgagcccaaactaagccatcatatcccctgtgacctgcacgtacacatccagatggcaggttcctgccttaactaatgacattccaccacaaaagaaatgaaaatggcctgttcctgccttaactgatgacattatcttgtgaaattccttctcctggctcatcctggctcaaaaacttccctactgagcaccttgtgaccccccactcctgcccgccagagaacccccttttgactgtaattttcctttacctacccaaatcttataaaatggccccacccctatctcccttcgctgactctcttttcagacaaagcccacctgcacccaggtgaaataaacagccttgttgctcacacaaagtctgtttggtggtctcttcacacggacatgcatgaaatttggtgctgtgactcggatcgggggacctcccttgggagatcaaacccctgtcctcctgctctttgctctgtgaaaaagatccacctaggacctcgggtcctcagacccaccagcccaaggaacatctcaccaatttgaagttggataagcagactcttcttattctcttctcccacctctctcactatccctcaaccactttctcctttcaatcttggcgtcacccttcaatctctcccttctcttaatttcagttcctttccttttctggtagagaacggagacgcgttttatctgtggacccaaaactccggcgccggtcacggacttaggaaggcagccttcccttggtgtttaatcattgcagggacgcctctctgattattcacccatgtttcagaggtgtctgaccatgcagggatgcctgccttggtccttcacccttagcagcaagtcccgcttttctaggggaggggcaagaactccaaccccttctctccatgtctctaccccttctctgcttttctgggaggcaagaaacccctgataccttatttctgtgccccgacctcttatctctgtgcctcgatcccttatttccacacccccacctcttatctctgtgccccatcccttatttccactccccgacctcctatctctgctccccaatcccttatttccatgccccgacccctttcccacttttctggagggtaagaacccccgaaccccttccctctgtgtctctactctctcttttttctgggcttgcgtccttcactatgggcaacattccaccctccattcctccttcttctcccttagcctgtgttctcaaaaacttaaaatctcttcaactcacatctgacctaaaacctaaatgccttatcttcttctgcaacaccgcttggccccaatacaaacttgacaatggctctaaatggccataaaattgcactttcaatgtttccatcctacaagatctaaataattcttgccgtaaaatgggcgaatggtctgaggtgcctgacgtccaggtattctttcacacatcggtccctctctagtctctgttcccaatgcaactcatcccaaatcttccatttttccctcccacctgtcccctcagtcccaatcccaagcgtcgctgagtctttctaatcttcctttgtacagacacatctgacctcttccctcctcgccaggccaagctaggtcccaattcttcctcagcctctgctcctccaccctataatccttttatcacctcccctcctcacacccagtctggcttacagtttccttccatgactagccctcccccacctgcccagcaatttcctcttaaaaaggtggctggagctaaaggcatagtcaaggttaatgttcctttttctttataccaaatcagagcacatttaggctctttttcatcaaatataaaaacccagcccagttcatggctcatttggcagcaaccatgagatgctttacagccctagaccctaaaatgtcaaaaggctgtcttattctcaatatacattttattacccaatctgctcccgacattaaataaaactccaaaaattaaattccagccctcaaaccccacaacaggacttaattaacctcatcttcaaggtttacaataatagagtagaggctgccaagtagcaacatatttctgaattgcaattccttacctccactgtgagacaaaccccagccacatctccagcacacaagaacttccaaacgcctaaaccgcagtggccaggtgttcctccaggcccgcctcccccaggagcttgccacaaatgccagaaatgtggccaccaggccaaggaatgcccgcagcctgggattcctcctaagctgcatcccatctgtgtgggaccccactgaaaattggactgttcaactcacctggcagccactctcagagcccctggaactgtggcccaaggctctctgactccttcccagatcttctcggcttagtggctgaagactgatcctgcccaatcgcctcggaagccccctagaacatcaccgacgctgagcttcaggtaactctcacagtggagggtaagtccgtccccttcttagtcaatacggaggctacccactccacgttaccttcttttcaaggcctgtttcccttgcctccataacttgtgggtattgacggccaggctactaaacctcttaaaactccccaactctggtgccaacttagacaatactcttttaagcactcctttttagttatccccacctgcccagttcccttattaggctgagacacttgaactaaattatctgcttccctgactattcctgggctacagccacacctcactgccaccttttcccccagttcaaagcctccttcacatcctccccttgtatctccccaccttaacccataagtataagacacctctattccctccttagtgaccgatcatgaaccccttaccatcccattaaaacctaatcactcttacctggctcaatgccaatatcccatcccacagcatgctttaaaatgattaaagtctgttatcactcgcctgttacagcatggccttttaaagcctataaactctccttacaattcccccattttacctgtcctagaaccagagaagccttacaggttagttcaggatctgagccttatcaaccaaattgttttgcctatccaccctgtggtgcccaacccatatactttcctatcctcaatacctccctccacaacccattattttgttctggatctcaaacatgctttctttactatccctttgcacccttcatcccagcctctcttcgctttcacttagactgaccctcacacccatcaggctcagcaaattacctgggctgtactgccagaagccttcacaaatagccccaattacttcagtcaagcccaaatttcatcctcatctgttacctatctcggcataattctcataaaaacacacgtgctctccctgctgatcgtgtccaactaatctcccaaacctcaatcccttctacagaacaacaactcctttccttcccagacatggttagatactttcaactttagatatctgattttgccatcgtaacaaaaccattatataaactcacaaaaggaaacctagctgaccccatagatcctgaatcctttacccactcctctttccgttccttgaagacagctttagagactgccctcaccctagctctgactcatcccaatccttttcattacacacagctgaagtgcagggctgtgcagtcagaattcttacacaaggaccaggattgcatcctgtagccttttggtccaaacaacttgaccatactgttttaggctggtcatcatgtctccgtgcagtggctgctgccgccctaatacttttagaggccctcaaaatcacaaactatgctcaactcactctctacagttctcataacttccaaaatctattttcttcctcacacctgacacatatactccctggctccttcagctgtactcactctttgttgagtctcccacaattaccattcttcctggcgcagacttcaatccagcctcccacattattcctgataccacacttgactcccatgactgtatctctctgatccacctgacattcaccccatttccccatatttccttatttcctgttcctcaccctgatcacgcttgatttattgatggcggttccaccaggcctaatcgccacacgccagcagaggcaggctatgctatagtaaaagccaccagcccgcctcttagaatctctcatttcctttccatcttggaaatctgtcctcaaggaaataatttctcagtgttccatctgctattctactactcctcagggattattcgggccccctcccttccccacacatcaagctcggggatttgcccccgcccaggactggcaaattggctttactcaacatgccccaagtcagaaaactaacatacctcttagtctgggtagacactttcactggataggtagaggtctttcccacagggtctgagaaggtcaccgcggtcatttcttcccttctgtcagacataattcttcggtttggccttcccacctctatatagtccgatagcagaccggcctttattagtcaaatcagccacgcagtttttcgctcttagtatccagtgaaacctttatatcccttacggtcctcagtcttcaggaaaagtagaacggactaaaggtcttttaaaaacacacctcaccaagctcagccaccaacttaaaaggactggacgtacttttaccactttcccttcttagaattcaggcctgtccttggaatgctacagggtacagcccatttgagctcctgtatggatgctcctttttattaggccccagtctcattccagacaccagactaacttagactgtgccccaaaaaacttgtcatccctactatcttctctctagtcatactcctattcaccattctcaactactcacacgtgccctgcttttgtttccactgccgtttactctgtttctccaagccatcacagctgatatctcctggtgctatccccaaaccgccactcttagctcttaaagtaaataaataatctttgcgggcaaggctgtgctgaacctccttaggcactctctaattagatgtcctaggtcctcccaattcttagtcctttaatacctgtttttctccttctcttactctgtttagtttttcaattcatacaaaaccgtacccaggccatcactaataattctacacaacgaatgtttcttctaacaaccccacagtatcaccccttaccacaaaatcttccttcagcttaatctctcccactctaggttcccacgacgcccctaatcccactcgaagcagccctgagaagcatcgcccattatctctccataccatcccccaaaattttcgctgtcccgacactttaccactatttcgttttatttttcttattaatataagaagacaggaatgtcagccctctgagctcaagctaagccatcatatccactgtgacctgcacgtacacatccagatggcaggttcctgccttaactgatgacattccaccacaaaagaaatgaaaatggcctcttcctgccttaactgatgacattatcttgtgaaattccttctcctggctcatcctggctcaaaagctcccctactgagcaccttgtgaccccccaactcctgcccgccagagaaaaaccccctttgactgtaagtttcctttacctacccaaatcttataaaacggccccacccctatctcccttcactgactctcctttcagactcagcccacctgcagccaggtgaaataaacagccttgttgctcacacaatgcctgtttggtggtctcttcacatggacgcgcatgaaa

SEQ ID NO: 64 - DNA, 757 bp, Homo sapiens
gagagagggctagctggatttcctaggccaactaagaatccctaagcctagctgggaaggtgaccgcatccacctttaaacacggggcttgcaacttagctcacacccgaccaatcagagagctcactaaaatgctaattaggcaaaaacagtaggtaaagaaatagccaatcatctatggcctgagaggacagcgagagggacaaggatcgggatataaacccaggcattcaagccggcaatggcaaccccctttgggtcccctccctttgtatgggagctctgttttcactctatttcactctattacatcttgcaactgcgctcttctggtctgtgtttgttacagctcgagctgagctttcgctcgccatccaccactgctgtttgccaccattgcagacctaccactgacttccatccctccagatctggcagggtgtccgctgtgctcctgatgcagccatgcgcccattgccactcccgatcgggctaaaggcttgccattgttccggtacggctaagtgcctgggtttgtcctaatcgagctgaacactagtcactgggttccatggttctcttccgtgacccacgacttctaatagagctgtaacactcactgcatggcccaagattccattccttggaatctgtgaggccaagaaccccaggtcagagaacacgaggcttgccaccatcttggaagtggcccaccactatcttgggagctctgggagcaaggacccccagtaacact

SEQ ID NO: 65 - DNA, 440 bp, Homo sapiens
ccaggccatcgcatcccaggccaggccatcgcatcccctgtgacttgcaggtatacatccagatggcctaaagtaactgaagatccacaaaagaagtaaaaacagccttaactgatgacattccaccattgtgatttgttcctgccccaccctaactgatcaatgtactttgtaatcttccccacccttaagaaggttatttgtaattctccccacccttgagaatgtactttgtgagattcacccctgcccaccagagaacaaccccctttgactgtaattttccattaccttcccaaatcctataaaacggccccacccctatctcccttcgctgactctcttttcggactcagcccgcctgcacccaggtgaaatacacagccatgttgctcacacaaagcctgtttggtggtctcttcacatggacgcacatgaaa

SEQ ID NO: 66 - DNA, 440 bp, Homo sapiens
gtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttataatctcccccacccttaagaaggttctttgtaattctccccagccttgagaatgtactttgtgagatccactcctgcccacgagagaacaaccccctttgactgtaattttccattaccttcccaaatcctataaaatggccccacccctatctcccttctctgactctcttttgggactcagccctcctgcacccaggtgaaataaacagccatgttgctcacacaaagcctgtttggtggtctcctcacacggacgcacatgaaa

SEQ ID NO: 67 - DNA, 1177 bp, Homo sapiens
aaaaagacaggaattgctcactcagggagctcggctcttgagacaggagtcttgctgatgcccctggccgaataaaccccttccttctttaactcagtgtctgaggagttttctgcgcctcgtcctgctacatttcttggttccctgatggggaagcgaggtgaatggcggatggtcgaggcagctccttaggcggcttaagcctgccgtgtggaacatccctgcgggcgactctaactagcccgggcgacgcggatcctgagagtgctccctggtaggcatttgccccaggaggacgcttcgccagagcagtgtgtggcaggcccctgtggaggatcaacacagtggctgaacaccaggaaggaacgggcacttagagtctggacatctaaaacttggtaagactagtctttgaaacttgcccactccaggccaggtgtggtgcctcaggcctgtaatcccagcactttgggaggccaaggcgggcggatgacgaggtcaggagatcgagaccatcctggctaacacggtgaaaccccttctctactaaaaatacaaaaaaattagctgggcgtggtggtgggtgcctgtagtccccaccagagcgagactccgtctcaaaaaaaaaaaaaaaagaaacttgcccactgcatttaagtggaagcgtggcctgatcacccatggtgtgcctgtaccggcactttagtttttgtttttgacttgacttagattgcttaatactctggttttggttttgacctaacttagatttctagatactctgattttagttttgattttagtttggtgcaaactgcgaaagtgtgtgtgtgccctttttacctgttctttgttttgtggtgtgcgtgtggtgtgagtgtggtgttttgtgtcgaagaagcataggtcaggcacaaataagcccaccctgctaggaactatgttgaaaaatttcaaaaaagaatttaaaggagactatagagtactatgacacgaggaaaacttaaaactttgtgtaagatagactggccagcattagaggtaggttggccattagaaaaaagcctggacaggtcccttgtttcaaaggtatggcacaaagtaacctgtaagccagggaacccagaccagttcccgtacatagacacttggttacagctagttttagaccccccgc

SEQ ID NO: 68 - DNA, 879 bp, Homo sapiens
aggcacccctacggaggaaatctcaactgcacaacccctactgtgccccaattcagcaggaagcagttagagcggtggtcaaacctccccaatagcacttgggttttcctgttgagagggggtactgagagacaggactagttggatttcctaggctggctaagaatccctaagcctagctgggaaattgaccacgtccacctttaaacacggggcttgcaatttagctcacacccgaccaatcaggtagtaaagagagctcactaaaatgctaattagggaaaaacaggaggtaaagaagtagccaatcatctatcgcctgagagcacaacaggagggacaatgatcaggatataaacccaggcattcaagccagcggtggctaccctctttgggtcccctccctttgtatggaagctctgttttcactctattaaatcttgcaattgcacacttttctggtacgtgtgtgtcacagctcaagctgagctttcgctcaccgtccaccactgctgtctgccgctgtcacagacccacagctgacttccatccctctggatccagcgaggcgcccattgctgctcctgatcgggctaaaggcttgcccttgttcctgcagggctaagtgcccaggttcgtcctaatctagctaaacactagtcactgggttccacgattctcttccatgacccacagcttctaatagagctataacactcgccgcttggcccaagattccattccttggaatccatgaggccaagaaccccaggtcagagaacacaagacttgccaccatctcggaagtggcccgtcaccatcttggaagcgacctgccaccatcttgggaacttggggagcaaggacccccagtaacat

SEQ ID NO: 69 - DNA, 3642 bp, Homo sapiens
gtcaggcctctgagcccaagccaagccatcgcatcccctgtgacttgcacgtataagcccagatggcctgaagtaactgaagaatcacaaaagaagtgaatatgccctgccccaccttaactgatgacattccactacaaaagaagtgaaaatggccggtccttgccttaagtgatgacattaccttgtgaaagtccttttcctggctcatcctggctcaaaaacctcccccactgagcacctttcgaccccgactcctgcccgccagagaacaaaccccctttgactgtaattttcctttacctacccaaatcctataaaacagccccacccttatctcccttcactgactctcttttccgactcagcctacctgcacccaggtgaaataaacagccatgttgctcacgcaaagcctgtttggtggtctcttcacacggacgcgcatgaaatttggtgccgtgacttggatcgggggacctcccttcggagatcaatcccctgtcctcctgttctttgctccatgagaaagatccacctacgacctcaggtcctcagactgaccagcccaagaaacatctcaccaatttcaaatccggtaagcggcctctttttactctcttctccaacctccctcactatccctcaacctctttctcctttcaatcttggcgccacacttcaatctctgccttctgttaatttcaattcctttcattttctggtagagacaaaggagacactttttatccgtggacccaaaactccggcgccagtcacggactaggaaggcagccttcccttggtgtttaatcattgcagggacacctctctgattattcacccatgtttcaaaggtgtcagaccactcagggacacctgccttggtccttcacccttagcggcaagtcctgcttttctggggaaggggcaagtaccccaactctttctctccttgtctctaccccttctctgcttttctgggggaggggcaagtacccctcaaccccttctccttcacccttagcagcaagtcccgcttttccagaggaggggcaagtaccccaacctcgtatctctgtgccccaatcccttatttccacgccacaacctcttatatctctgcaccccagtcccttatttccacaccctgacttcttatctctgcaccccaatcccttatttccatgccccgaccccttatttctgtgccccgaccccttatttccatgccccgaccccttatttctgcaccccatcccttatttctgtgccgcaacctcttatctctgtgccccaaccccttttcccacttttctagaaggtaagaacccccgaaccccttccctccatttctctactctctcttttctctaggcttgcttccttcactataggcaactttccaccctccattcctccttctactcccttaacctgtgttctcaaaaacttaaaacctcttcaactcacacctgacctaaaacctaaatgtcttattttcttctgcaatgctgcttgaccccaatacaaactcgacagtagttccaaatagccagaaaacggcactttcaatttttccattctacaagatctaaatacttcttatcgtaaaataggcaaatggtctgaggtgactgacgtccaggcattttttacacatcagtcccttcctagtctctgtgcccagtgcaactcgtcccaaatcttctttcccttccgcctgtcccctcagtcccaaccccatgcatcactgagtctttctaatcttctttttctacagacccatctgacctctaccctcctcgccaggccaagctaggtcccaattcttccaccctataatctttttattgcctcccctcctcatacctggtccggcttacagtttccttccgtgactagccctcccccacctgcccagcaatttcctcttaaaaaggtggctggagccaaaggcatagtcaaggttaatgctcctttctctttatcccaaatcagatagcgtttaggctctttttcatcaaatataaaaacccagcccagttcatgtctcattcggcagcaaccctgcgacgctttacagccctagaccctaaaaggtcaaaaggccatcttattctcaatatacattttattacccaatctgctcctgacattaaataaaactccaaaaattagaatctggccctcaaacctcacaacaggatttaattaacctcaccttcaaggtgtacaataatagaaaaaagttgcaattccttgcctccactgtgagacaaaccccagccacatctccagcacacaagaaattccaaacacctgaaccacagcggccaggcattcctccagaacctcctcccccaggagcttgctacaagtgccagaaatctgaccaccaggccaaggaatgcctgcagcccaggattcctcctaagccgtgtcccatttgtgcaggaccccactggaaatcggactgttcaactcacctggcagccactcccggagcccctggaactctggcccaagactctctgactgactccttctcggcttagcggctgaagactgacgctgcccggtcgcctcggaagccccgtagaccatcagggacgccgagctttgggtaactctcacagtggaaggtaagcccgtccccttcttaatcaatacagaggctacccactccacattaccttcttttcaagggtctgtttcccttgcctccataactgttctaggtattgacggccaggcttctaaacctcttaaaactccccaaatctagtgccaacttagacaatactcttttaagcactcctttttagttatccccacctgcccagttcccttattaggctgagacactttaactaaattatctgcttccctgactgttcctggactacagctgtatctcattgccgcctttcttcccaatccaaagcttcctttgcgtcctcctcttgtatccccccaccttaacccacaagtataagatacctctactccctccttggtgaccgatcatgcaccccttaccgtgtcattaaaacctaatcacccttaccccactaaatgccaatatcccatcccgcagcacgctttaaaaagattaaagcctgttatcactggcctgctacagcatggccttttaaagcctataaactctccttataattcccccattttacccatcctaaaactgcacaagtcttacagattagttcaggatctgcatcttatcaaccaaactgttttgcctatccaccctgtggtgcccaagctgtacactcttttgtcctcaataccttcctccacaactcactattccgtgcttgatcttaaagatgcttttttcactattcccctgcacccctcgtcccagcctctcttcgctttcacttagactgaccctgacacccattaggctctgcaaattacctaggctgtactgccgcaaggcttcatagacagcccccattacttcagtcaagcccaaatttcatcctcatctgttacctatctcgccataattctcataaaaacacacgtgctctccctgctgatcatgtccgattaatctcccaaacctcaatcccttacaaaacaacaactcctttccttcctaggcatagttag

SEQ ID NO: 70 - DNA, 5603 bp, Homo sapiens
cctttgctgactctctttttggactcagcccacctacacccaggtgaaataaacagccttgttgctcacacaaagcctgtttggtggtctcttcacacagaagcatgagacatttggtgctgaagacccgggtcagagggactccttcgggagaccagtcccctgtcctcaccctcactccgtgaagagatccacctatgacgtcaggtcctcagaccaaccagcccaaggaatatctcaccaatttcaaatcgggtaaacagtcttttcactctcttctccagcctctctccctacccttcaatctccctgtccttccaagtccagttatttttcctctctaatagagacaaacgagacacattttatccatggacccaaaactctggcgccagtcaccaacttaggaagacagcctacccttggtgtttaatcattgcagggtgtgcctgcttgattattcacccacaccccattggtgtctgatcaccacggggatgcctgccttggtcattcacccacattcccttggtggcaagtcaattgtggggacacctgctttggctgctcacccacattgcagcccaggactgctccccaccccgcttctccgtgtctctacccttctctttaaacttgcctcctttactatgggcaaccttccaccctccatttctccttcttctcccttagcctgtgttctcaagagcttaaaacctcttcacctcttgcctgacctaaaatctaagcatcttattttcttctccaacaccgcttggccccaatacaaactcgacaatggttctaaatggccagaaaatgacactttcgatttctccatcccacgagacctagatactttttgtcgaaaaaagggcaaatggtctgaggtgccttacgtccaggcatttttcacactttgttccctccttagtctctgttcccaatgcgactcatcccaaatcctccttctttccctcccgcctgtcccttcagtctcaaccccagtcgtcactgagtcttgtgaatcttccttttctgctgacccatctgacccctcacctcctccccagactgctcctcctcagctcgctccccgccaggctgaatcaggctccaactcttcttcagcctctgctccctcaccctataacccttctattaactccccttcccacacccggtctggtttacagtttcattctgcgactagctctccccctcctgcccaacaatttcctcttagagaggtggctggagctgaaggcatagtcagagtacatgtgcctttttctctaccaaacgtttcccaaatcagccagcgtttaggctctttctcatcagacaccaataaatatatacaggaattccaatatctaactctgtcctacagtttaacctggagagacttaaatgtcagcctaacttctaccctctccccagatgaatgggaaagagtcttctctctagcccaatctcacgctgataatcaccggcttcatgagccagacctccaggaaggcattagagcagttccctgagaagatcccctatggaactatcaggcagattccccaggtatagctaggcgaaattacatggtttcttgcctagttgaagggcttaaaaaggcagctcacaaagctgttaattatgacaaacttaaagaaactacccaaggtaaagatgaaaacccagcccagttcatggcctgcttagttagcagaaatccttagatgctttaccgccctagacccagagggaccagaaggtcaccttattcttaatatgcattttatcacccagtcagctcctgacattagaaaaaagcttcaaaaattggaatccggccttcaaaccccacaacaggaattaatcaacctcgccttcaaggtgtacaataatagagaggaggtggccagacagcaacgcatttctgagttacagctacttgcctccgctgtaagacaacccacaaccacatctccagcatacaaaaaaacttcagaacatccaagccacagctcccagaggctccttaaaaacatcctcgtggaccttgtttcaaatgccaaaagcctggccactgggcctcagaatgcccacggcccgggattcctcctgagccgtgccctgtctgtgcaggcccccactggaggtcagactgtccgactcacattgctgctgctcctgaagcccctggagcccaaacccaatgttccctggccaactccttccagatctgatgctgccggatcacctcggaagcctcctggaccatcacagatgctttgggtaactctcacagtggagggtaagtacatccccttattaatcaatacggaggcaacccactccacattaccttcttttcaagggtgtgtttcccttgcctccataactgttgtggattatgacagccaggcttcttaacctcttaaaactccccaactctggtgccaacttggacaattttcttttatgcactcctttttagttatcctcacctgcccagctcccttattggctcgagacattttaactaaattacatgcttccctgactattcctaggctacagccatacctcattaccgcccttttcccccagttcaaagcctccttcacatcctctccttgtatctccccaccttaatccacctctactccctccttgaggatggatgatgcaccccttaccatcccattaaaacctaatcacccttaccccgatcaatgccagtatcccatcccaccgcatgctttaaaaggattaaagcctgttatcacttatctgttgtagcatggccttttaaagcctataaactctccttacaattcccccattttacctgtccaaaaactggacaagccttacattttagttcaggatctgcgccttatcaacaaaattgtcttgcctatccaccccatggtgccaaacccatatattctcctatcctcaatacctccctccacaacccattattctgttctagataaacctagctgaccccataaatcctaaatcctttccacactcccctgtccattccttaaaaaacagccctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaaacagccctaaaatctgctcccacactagttctccctaactcatcccaacctttttcattacacacagccgaagtgcagggctatgtggttggaattcttacacaagagccaggaccacgccctgtagcctttctgtccaaataacttgaccttactgttttagcctagccctcatgtctgcgtggggtggctgccactgccttaatacttttagagaccctcaaaatcacaaactatgctcaactcactctctacagttctcataacttccaaaatctattttcttcctcacacctgatgcatatactttctgccctcctccactacctctcagcaagccaaactcattgccttaactcgagccctcactcttgcaaaaggactacgtatcaatatttatactgactctaaatatgccttccatatcctacaccaccatgctgttttatgggctgaaagaggtttcctcactactcgagggtcctccatcattaatgcctctttaataaaaactcttcttaaggccgctttacttccaaaggaagctggagtcattcactgcaagggccattaaaaggcatcacatcccatcgctcagggcaacgtttatactgataaggtagctaaagaagcagctagccttccaacttctgtccctcacggccagtttttctccttctcattggtcactcccacctactcaccgactgaaacttctacctatcaacctcttcccacacaaggcaaatggttcttggaccaaggaaaatatctccttccagcctcacaggcccattctaatctatcatcatttcataacttcttccatgtaggttacaagctgctagcccgcctcttagaacctctcatttcctttccatcatggaaatctatccttaaggaaatcacttctcagtgttccatctgctattctactactcctcagggattgttcaggccccctctcttccctacacatcaagctcggggatttgcccctgcccaggactgggaaattgactttactcacatgccccgagtcagaaaactaaaatacctcttggtctgggtagacactttcactagatgggtagaggcctttcccacagggtctgagaaggccaccacagtcatttcttcccttttgtcagacgtaattcctcagtttggccttcccacctatatacagtccaataacgggcctgcctttattagtcaaatcacccaagcagtttctcaggctcttggtatttagtggctcctggttttacctcaaatcgccacccttaagcctctcttgaattggatagaagatcttcagtggcaaggtaccctccaatactttcaccctgatgaagtcctattctttatttttatactcactcttattctggttcccgttcttatgccaccttctacctctccgcagctatctccaccacactatcaaattcactctctcctagccgtttctaatccttctttaacaaacaattgctggctttgcatttcactttcctccaaaatcgctgaggccctgacttactcactgctaaaaaaaagggggggactgtatatttgtaaatgaagagtgttgtttttacctaaatcaatctggcctggtatatgacaacataaaaaaaactcaaggatagagcccaaaaacttgccaaccaagaaaataattatgctgaaccccctttgacactctgtaattggacgtcctgggtgctcccaattcttagtcctttaatacctgtttttctctttctcttatttggaccttgtgtctttcgtttagtttctcaattcatacaaaaccacatccaggccatcaccaataattctatactacaaatgctccttctaacaaccccacaatatcaccccttaccccaaaacctttcttcagttgggtctctcccactgtaggttcccacgccaccccaatcccgcttgaagcagccctgagaaatcacccattatctctccataccaccccaaaaaattttcaccgccccaacactttaccactatttcattttatttttcttattaatataagaagacaggaatgtcaggcctctgagcccaggctaagccatcataacccctgtggcctgcatgcatacatccagatggcctgaagcaactgaagatccacaaaagaagtgaaaatagccttaactgataacattccaccat

SEQ ID NO: 71 - DNA, 2123 bp, Homo sapiens
tgactctctgtttggactcagcccacctgcacccaggtgaaataaacagccatgttgctcacacaaagcctgtttggtggtctcttcacacggacgcacatgaaatttggtgtcgtgactcggatcgggggacctcccttgggagatcaatcccctgtcctcctgctctttgctctgtgagaaagatccacctacgacctcaggtcctcagaccgaccagcccaagaaacatctcaccaatttcaaatccagtaagcggcctctttttactctcttctccaacttccctcactatccctcaacctctttctcctttcaatcttggcgctacacttcaatctctcccttctcttaatttcaattcctttcattttctggtagagacaaaagagacacgttttatccgtggacccaaaactccggcgccggtcacggactgggaaggcagccttcccttggtgtttaatcattgcagggacgcctctgtgattatacacccacgtttcaagggtgtcagaccacgcagggacacctgccttggtccttcacccttagcggcaagtcctgcttttctggggaaggggcaagtaccccaaccccttctctccttgtctctaccccttctctgcctttcctggggcaggggcaagtacccctcaaccccttctccttcacccttagaggcaagtcccgctttcctaggggcaagaacctcccaatcgcttatttccgcaccccaacctcttatctctgtgccccaatcccttatttccgtgccccaaccctttctctgcttttctggagggcaagaactccccaccccttctccatgtctctactcttttctctgggcttgcctccttcactatgggtaggcttccaccttccattcctccttgttctcccttagcctgtgttctcaaaaacttaaaacctcttcaactcacacctgacctaaaacctaaatgccttattttcttctgcaatgccgcttgaccccaatacaaactcgacagtagttccaaatagctggaaaacggcgctttcaatttttccatcctacaagatctaaataattcttgtcgtaaaatgggcaaatggtctgaggtgcctgacgtccaggcattcttttacacatcagtcccttcctagtctctgtgccccgtgcaactcgtcccaaatcttccttctttccctccctcctgtcccctcagtcccaaccccaagcggcgctgagtctttctaatcttcctcttctacagacccatctgacctctcccctccgcgccagcccaagctaggtcccaattcttcctcagcctccgcgcctccccccccttcatcccacacctggtccgacttacagtttcattctgtgactagccctcccccacctgcccagcaatttactcttaaaaaggtggctggagccaaaggcatagtcagggttaatgctcctttttctttatcccaaatcacatagcgtttaggctctttttcatcaaatataaaaacccagcccagttcatggctcgttcggcagcaaccctgagacgctttacagccctagaccctaaaaggtcaaaaggccatcttattctcaatatacattttattacccgatctgctcccgacattaaataaaactccaaaaattaaattccggccctcaaaccccacaacaggatttaattaaccttgccttcaaggtgtacaataatagaaaaaagttgcaattccttggctccactgtgagacaaaccccagccacatctccagcatacaagaacttccaaatgcctgaaccgcagcggctaggcgttcttctagaacctcctcccccaggagcttgctacaagtgccagaaatctgaccaccagggcaaggaatgcctgcagcccaggattcctcctaagccgtgtcccatctgtgcgggaccctactggaaattagactgttcaactcacctggcagccactccccgagcccctgcaactctggcccaaggctctctgactgactccttctcggcttagcggctgaagactgatgctgcccgatcgcctcggaagccccataggccatcacggacgccgagctttgagtaactctcagagtggaag

SEQ ID NO: 72 - DNA, 5806 bp, Homo sapiens
gtcaggcctctgagcccaagccaagccatcgcatcccctgtgatttgcacatgtacgcccagatgacctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactaattttcctttacctacccagatcctataaaatggccccacccctatctcccttcaccgactctcttttcggactcagtccgcctgcacccgggtgaaataaacagccatgttgctcacacaaagcctgtttggtggtctcttcacacggacgtgcatgaaatttggtgccgtgactcggatcgggggacctcccttgggagatcaatcccctgtcctcctgttctttgctccacgagaaagatccacctacgacctcaggtcctcagactgaccagcccaaggaacatctcaccaattttaaatcaggtaagcggcctcttcttactctcttctccaacctctctcactgtccctcaaccactttcttctttccactcttcaatctctcccttctcttaatttcaattcctttcattttctgggagagacaaaggagacatgtttttatccgtggacccaaaactccggcgctggtcacggactgggaaggcagccttcccctggtgttttatcattgcagggacgcctctctgattattcacccacgtttcaaaggtgtcagaccacgcagggacgcctgccttggtccttcacccttagcagcaagtcccacttttctgggaaaggggcaagtacctcaaccccttctctccttgtctctaccccttctctgcttttctgggggaggggcaagtacccctcaaccccttctccttcactcttagcggcaagtcccgcttttctagaggatgggcaagtaccccaacctcgtatctctgtgccccaatcccttatttccgcgccccaacctcttatatctctgtgccccaatcccttatttccatgctcgaccccttatttccgtgcccctaccccttatttctgtgcttcatcccttatttccatgccccgacctcttatctctgcgccccaacctcttttcccacttttctggaaggtaagaacccccgaaccccttccctcagtttctctactctctcttttctctaggcttgcttccttcactataggcaaccttccacccttcattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaagtaattcttgtcgtaaaatagccaaatggtctgaggtgcctgacgtccaggcattcttttacacatcagtcccttcctagtctctgtgcccagtgccactcatcccaaatcttccttctttccctcccgcctgtcccctcagtaccaaccccaagcatcgctgagtctttctaatcttccttttctacagatccatctgacctctcccttcctccccaggctgctcctcgccaggccgagctaggtcccaattcttcctcagcctctgctcctccaccctataatcttttcatcacctcccctcctcacacctggtctggcttacagtttcgttccatgactagccctccccctcctgcccagcaatttactcttaaaaaggtggctggagccaaaggcatagtcaactttaatgctcctttttctttatcccaaatcagatagcgtttaggctctttttcatcaaatataaaaatccagcccagttcatgacttgtttggcagcaaccctgagacactttacagccctagaccctaaaaggtcaaaaggccgtcttattctcaaaatacattttattacccaatctgctccagacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacacaggaacttccaaatgcctgaaccgcagcggccaggctcctccagaacctcctcccacaggagcttgctacatgtgccagaaatctggccactgggccaaggaatgcctgcagcccgggattcctcctaagccgtgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagaccatcacagacgccgagcttccggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattgtctgcttccctgactattcctggactacagctatatctcattgccgcccttcttcccaatccaaagcctcctttgcgtcctcctcttgtatccccccaccttaacccacaagtataagatacctctactccctccttggcgaccaatcatgcacccgttaccatctcattaaaacctaatcacccttaccccactcaacgccaatatcccatcccgcagcatgctttaaaaagattaaagcctgttatcacttgcctgctacagcatggccttttaaagcctataaactctccttacaattcccccattttacctgtcctaaaaccggacgagccttacaagttagttcaggatctgcgccttatcaaccaaattgttttgcctatccaccccgtagtgccaaacccatatactctcctatcctcagtacctgcctctataacctattattctgttctagatctcaaacatgctttctttactattcctttgcacccttaatcccagcctctcttcactttcacttggactgaccctgacacccatcaagctcagcaagttacctaggctgtactgccgcaaagcttcacagacagcccctattacttcaatcaagcccaaatttcttcctcatctgttacctatctcagcataattctcataaaaacacacgtgctctccctgccaatcatgtccgactaatctctcaaacccaagcaccttctacaaaacaacaactcctttccttcctaggcatggttagcgtggtcagaattcttacacaagagccaggaccgcaccctgtagcctttctgtccaaacaacttgaccttactgttttagcctagccctcatgtctgcgtgcagcggctcccgctgctttaatacttttagaggccctcaaaatcacaaactatgctcaactcactctctacagttctcataacttccaaaatctattttcttcctcatacctgacgcacatactttctgctccccggctccttcagctgtacccactctttgttgagtctcccacaattaccgttgttcctggcccagacttcaatccggcctcccacgttattcctgataccacacctgacccccatgactgtatctctctgatccatctgacattcaccccatttccccaaatttccttctttcctcttcctcaccctgatcacgcttgatttattgttggcggttccaccaggcctaatcaccacacaccagcaaaggcaggttatgctatagtacaagccactagcctgcctcttagaacctctcatttcctttccatcgtggaaatcgatcctcaaggaaataacttctcagtgttccatctgctattctagtactcctcagggattattcaggcccccttccttccctacacaccaagctcaaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacaagcatttattagtcaaatcagccaagcagtttttcaggctcttagtattcagtgaaacctttatgtcccttatggtcctctgtcttcaagaaaagtagaatggactaaaggtcttttaaaaacacactcagccaccaacttaaaaaggactggacaatacttttaccactttcccttctcagaattcaggcctgtcctcggaatgctgcagggtacagcgcatttgagctcctgtatagacactcctttttattaggccccagtctcattccagacaccagaccaacttacactgtgccgcaaaaaacttgtcatccctactatcttctgtctagtcatactcctattcaccattctcaactactcatacatgccctgctcttgtttacactgccggtttacactgtttttccatgccatcacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttcctttattccatttagtttctcaattcatccaaatccatatctaggccatcaccaatcattctatatgacaaatgtttcttctaacatccccacaatatcaccccttaccacaaggcctcccttcagcttaatctctcccactctaggttcccacgtcacccctaatcccgcttgaagcagccctgagaaacatcgcccattctctctccataccaccacccaaaaatttttgccgccccaacacttcaacactattttgttttatttttcttattaatgtaagaaggcaggaatgtcaggcctctgagcccaagccaagccatggcatcccctgtgatttgcacatgtacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactgctgcctgccagagaacaacccccctttgactgtaattttcctttacctacccaaatcctataaaacggccccacccctatctcccttcactgactctcttttcggactcagtccgcctgcacccgggtgaaataaacagccatgttgctcacacaaagcctgtttggtggtctgttcacacggacgtgcatgaaa

SEQ ID NO: 73 - DNA, 5708 bp, Homo sapiens
gtcaggcctctgagcccaagccaagtcatcgcatcccctgtgacttgcacatatacgcccagatggcctgaagtaactgaagaatcacaaaagaagtgaaaatgccctgccccgccttaactgatgacattccaccacaaaagaaatgaaaatggccggtccttgccttaagtgatgacattaccttgtgaaagtccttttcctggctcatcctggctcaaaaagctcccccactcagtaccttgtgactcccacttctgcctgccagagaacaacgcccctttttcctttacctacccaaatcctataaaacggccccacccctatctcccttcactgaccctcttttcggactcagcccacctgcacccaggtgaaataaacagccttgttgctcacacaaagcctgtttggtggtgtcttcacacggacgcacatgaaatttggtgtcgtgattcggatcggaggacctcccttgggagatcaatcccctgtcctccggctctttgctccgtgaaaaagatccatctatgacctcgggtcctcagacccaccagcccaaggaacatctcaccgattttaaatcgggtaagcggcctcttcttactctcttctccaacctctctcactctccctcaaccactttctcctttcaatcttggtgccacccttcaatctctcccttctcttaatttcaattcctttccttttctggtagagacaggagacacgttttatccgtggacccaaaactctggcgccggtcacggacttgggaagacagtcttcccttggtgtttaatcacacggggacaactgcctgattattacccacgtttcagaggtgtctgaccacgcggggacgcctgccttggtccttcacccttagcagcaagtaccgcttttctggggggcaagaaccccccaaccccttctctccatgtctctaccccttctccactgttctgggggacaagaaccccccaaccccttctctctgtgtctctaccccttctctgcttttctgggggcaagaaccccccgatcctttatttccacaccccgctctgtgccccgatcccttatttctgcaccccgacttcttatctctgtgccccaaccccttatttccatgccccgacccctttcctgcttttctggaaggtaagaacccctgaaccccttccctccatgtctttactctcccttttctttaaacttgcctccttcactataggcaaccttccaccctccattcctccttcttctcccttagcctgtgttcttaagaacttaaaacctctcaactctcacctgacctaaaacctaaatgccttattttcttctgcagtgctgcttgaccaaaatacaaactcaacagtggttccaaatagcaagaaaatggcactttcaatttttccatcctacaagatctaaataattcttgtcgtaaaataggcaaatggtctgaggtgcctgacgtccaggcattcttttacacatcagtccctccctagtctctgttcccaaggcaactcgtcccaaatcctccttctttccctcctgcctgtcccctcagtcacaactccaaatgtcgctgagtctttctaatcttccttttctacagacccatctgacctcctcgccaggccgagccaggtcccagttcttcttcagcctctgctccccaccctataatccttttatcacctccattcctcacaccgggtccagcttacagttttgttcctcgactagtcttcccccacctgcccagcaatttcctcttaaaaaggtggctggagctaaaggcacagtcaaggttaacgctcctttttctttatccgacctctcccaaaatcagttagcatttaggctttttttcatcaaatatgaaaaacccagcccagttcatggctcatttggcagcaaccctgagacgctttacagccctagaccctgaaaggtcagaaggccgtcttattctcaatatgcattttattttttttacccaatctgctcccaacatgaaataaagctccaaaaattaaattccggccctcaaaccccacaacaggacttaattaaccccgccttcaaggtgtgcaataataaagtagaggcagccaagtagcaatgtatttctgagttgcaattccttgcctccactgtgagacaaaccccagccacatctccagcacacaagaactccaaacgcctgaacctcctcccccaggagcttgccacaagtgccggaaatctgaccactgggccaaggaatgcccacagcccgggattcctcctaagccatgtcccatctgtgcgggaccccactgaaaattggactgttcaactcacctggcagccacttccagagcccctggaactctggcccaaggctctccgactgactccttcccagatcttctcggcttagcagctgaagactgacgctgcccgatcgcctcggaagcctacaggaccatcacaaatactctgagtaactctcacagtggagggtaagtccatctccttcttagtcaatatggaggctacccactccacattaccttcttttcaagggcctgtttcccttgcctccataactgttgtgggtattgacggccaggcttctaaacctcttaaaactcccaaactctggtgccaacttagacaatactctttgaagcactcctttttagttatccccacctgcccagttcccttgttaggctgagacactttaactaaattatctgcttccctgactattcccggactacagctgcatctcattgccacccttctccccaacccaaagcctcctttgcatcttcttctcatatccccccaccttaacccacaagtatgggacatctctactccttccctggcaactgatcacatgcccattaccatcccattaaagcctaatcactcttaccctgctcaatgttaatatcccatcccacagcacgctttaaaaggattaaagcctgttatcactcacttgctacagcatggccttttaaagcctatatactctccttaccattcccctatttcacctgtcctaaaaccagacaagtcttataggttagttcaggatctgtgccttatcaaccaaattgttttgcctatccacccccgtggtgccaaacccatatactctcctatcctcaatacctccttctacaacccattattcttttctggatctcaaacatgctttctttactattcctttgcacccttcatcccagcctctctttgctttcacttggactgaccctgacacccattaggctcagcaaattacctgggctatactgccgcaaggcttcacagacagcccccattacttcagtcaagcccaaatttcatcctcatctgttacctatctcggcataattctcacaaaaacacacgtgctttccctgctgattgtgtctgactaatctcccaaacctcaatcccttacaaaacaacaactcctttccttcctaggcatggttagtgtggtcagaattcttacacaagagccgggaccacaccctgtagcctttctgtccaaacaacttgaccttactgttttagcctagccctcatgtctgcgtgcagcagctgccactgctctaatacttttagaggccctcaaaatcacaaactatgctcaactcactttctacagttctcataatttccaaaatctattttcttcctcacacctgacacttatactttctgctcccccggctccttcagttgtacccactctttgttgagtcccacaattaccattgttctcggcccggacttcaatccggtctcccacattattccagataccacacctgaccctcatgactgcatctctctgatccacctgacgttcaccccatttccccacatttccttcttccctgtttctcaccctcatcacatttggtttattgatggcagttccaccaggcctaatcaccactcaccagcaaaggcagactatgctatagtactagccactagcccgcctcttagaacctctcatttcctttccatcgtggaaatctatcctcaaggaaataacttctcagtgttccatctgctattctactactcttcatggattattcaggccccctcccttccctacacatcaagctcggggatttgcccccgcctaggactggcaaattggctttactcaatatgccccaagtcagaaaactaaaatacctcttagtctgggtggacactttcactggatgggtagaggcctttcctacaggatctgagaaggccactgcggtcatttcttcccttctgtcagatataattcctcagtttggccttcccacctctatacagtctgataacggaccagcctttattagtcaaatcagccaagcagtttttcaggctcttggtattcagttaaacctttatatcccttacggtcctcagtcttcaggaaaggtagaacggactaatggtctttaaaaaacacacctcaccaagctcagccaccaacttaaaaaggactggacaatacttttaccactttcccttctcagaattcaggcctgtccttggaatgccacagggtacagcccgtttgagctcctgtttggacgctcctttttattaggccccagtctcattccagacaccaaaccaagttggactgtgccccaaaaaacttgtcatccctactatcttctgtctagtcatactcctattcaccgttctcaacgactcatacatgccctgctcttgtttacactgccggtttacactgtttctccaagccatcacagctgatatctcctggtgctatccccaaaccgccactcttaactcttaaagtaaataaataatctttgctggcaggactatgctgaatctccttaggcactctctaattagatgtcctgggtcctcccaattcttagacctttaatacctgtttttctccttctcttattccatttagtttttcaattcatacaaaaccatatccaggccatcaccaataattctaaatgacaaatgtttcttctaacaaccccacaatatcaccccttaccacaagacctcccttcagcttaatccctcccactctaggttcccacgccgcccctaatcccgcttgaagcagccctgagaaacatcacccattctctctccataccacctcacaaaaattttcgccgccccaacacttcaacactgttttgttttatttttcttattaatataagaaggcaggaatgtcaggcctctgagcccaagccaagccatcgcatcccctgtgacttgcacatatacgcccagatggcctgaagtaactgaagaatcacaaaagaagtgaaaatgccctgccccgccttaactgatgacattccaccacaaaagaagtgaaaatggccggttcttgccttaagtgatgacattaccttgtgaaagtccttttcctggctcaaaaagctcccccactcagtaccttgtgacccccacccctgcctgccagagaacaacgcccctttttcctttacctacccaaatcctataaaacggccccacccttatctcccttcactgaccctcttttcggactcagcccacctgcatgcacccaggtgaaataaacagccttgttgctcacacaaagcctgtttggtggtctcttcacatggacgcgcatgaaa

SEQ ID NO: 74 - DNA, 972 bp, Homo sapiens
gtggggaaaagaaagagagatcagattgttactgtgtctgtgtaggaagaagtagacataagagactccattttgttctgtactaagaaaaattgttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctccggctcgtccctgggcaatggaatgtctcggtgtaaagcccgattgtatattccatctactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgccggcatgggtcctccgtatgctgaacgccggtcccctgggcccatttttcttcctctgtactttgtctctgtgtctctttcttttccaagtctctccttccacctaatgagaaacgcccacaggtgtggaggggcaacccatcccttca

SEQ ID NO: 75 - DNA, 2294 bp, Homo sapiens
tgactcctttttcagactcagcccacctgcaccaggtgattaaaaagctttattgctcacacaaatcctgttggtggactctcttcacacggatgcacttgacattttgtgctgaagacccaggacaggaggactccttcgagagaccagtcccccatccttgccctcactcggtgaggagatctacctatgacctcaggtcctcagaccaaccagcccaaggaacatctcaccaatttcagatcgggtaagcggtcgtttcactcccttctccaacctctctcactatccctccacccttcaatctctcccttccttaattttggttccttttcccctttctggtagagacagaggagatgcattttatctgtgaactcaaaactccagcgctggtcacagactcgggaagacagtcttcccttggtgtttaatcactgcggggacgcctgcctgattattcacccacatttcagaggtgtctgatcaccatggggatgcctgccttgatccttcaccttggtggcaagtaccaccccccgccctctgtgtctctaccctctcttttctctaaacttacccttttactatgggcaaccttctgccctccattcctccttcttctcccttggcctttgttctaaaaaacttaaaacctcttcaactcccacctgatctaaaacctaagcgtcttattttcttctgcaacactgcttggccccaatacaaacttggtaatggctccacatagtcagaaaatggcactttcgattttctccatcctacaagatctagataatttttttcaaaaaatgggcaaatggtctgaggtgcctgatatccaggcattcttttatacattggtccctccctagtctctgctcccaatgtgactgtcccaaatctttcttgtttttctcccgtctgttccttcagtctccaccccaagctctgagtcctttgaatcttccttttctacagacccacctaacctctcccctccaccccaggctgctcctcgccaggccgagccaggtcccaattcttcctcagcctccactcccccaccctgtaatccttctatcacctcccctcctcatacccagtctggcttacaattttgttccacaacttgccctcccccacctgcccaacaatttcctcttagagaagtggctggagctgaaggcatagtcaaggttaatgctcctttttctttagccaacctctcccaaatcagttagcgtttaggctctttttcatcaagtataaaaacccagcccagttcatggcccatttggcaacaacccttagacgctttactgccctagacacagaggggccagaaggccgtcttattctcaatatgcattttattacccaatccactcctgacattagaaaaagctccaaaaattaagattctggccctcaaaccccacaacaggacttaattaacctcgccttcaaggtgtacaataatagaggcagccaagtggccacgtatttctgagttgcaattccttgcctccactgtaagacaaaccccagccacatttccagcacacaagaacttcaaaaacctaaaccatagcagccaggcattcctccaggacctcctcccccaggatcttgcttcaagtgccagaaatctggccactgggccaaggaatgcccgcagcccaggattcctcctaagatgtgtcccatctgtgtgggaccccactggaaattggactgtccagctctcccagcagccactcccacagcccctggaactgtggcctaaggctctctgactcctttccagatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggcaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccactcctatctccctttgctgactcctttttcggactcagccaacctgcacccaggtgattaaaaagctttatttctcacccaaagcctgttggtggtctcttcacacggatgcgcatga

SEQ ID NO: 76 - DNA, 5711 bp, Homo sapiens
gtcaggcctctgagcccaagccaagccatcacatcccctgtgacttgcacggatatgaccagatggcctgaagtaactgaagaatcacaaaagaagtgaaaaggccctgccccgccttaactgatgacattccaccattgtgatttgttcctgccccaccttaactgagtgattaaccctgtgaatttccttctccaggctcagaagctcccccactgagcaccttgtgacccccgcccctgcccaccagagaacaaccccctttgactgtaattttccattgccttcccaaatcctataaaacggccccatccctatctcccttcactgactctcttttcggactcagcccgcctgcacccacgtgaaataaacagccatgttgctcacacaaagcctgtttggtggtctcttcacacggacacgcatgaaatttggtgctgtgactcagatcgggggacctcccttaggagatcaatcccctgtcctcctgctttttgctccataagatccacctaggacctcaggtcctcagatcgaccagcccaagaaacatctcaccaatttcaaatccggtaagcggcctctttttactctcttctccaacctccctcactatccctcaacctctttctcctttcaatcttggaaccacacttcaatctctcccttctcttaatttcaattcctttcattttctggtagagacaaaggagacacgttttatccatggacccaaaactccagcgctggtcacggactagggaaggcagcctttccttggtgtttaatcattgcagggacgcctctctgattattcacctatgtttcaaaggtgtcagaagacacagggatgcctgccttggtccttcacccttagcggcaagtcccgcttttctggggaaggggcaagtaccccaaccccttctctccttgtctctatctcttctctgcttttctgggggaggggcaagtacccttcaaccccatctccttcactgttagtggcaagtcccacttttctagaggggtaagtaccccagcctcgtatctctgcgccccaatcccttatttccatgccccgaccccttatttccgtgccctgaccccttatttccatgccctgaccccttatttctgtgccccatcccttatttccatgccccgacctcttatctctgagccccaaccacttttcccacttttctagaaggtaagaacccccaaaccccttccctccatttctctactctctctttcctctaggcttgcttccttcgctataggcaaccttccaccctccattcctccttctactcccttggcctgtgttctcaaaaacttaagacctcttcaactcacacccgacctaaaacctaaatgtcttattttcttctgcaatgccgcttgaccccaatataaacttgacagtagttccaaatagccagaaaacggcactttcaatttttccatcctacaggatctaaataattcttgttttaaaataggcaaatggtctgaggtgcctgacatccaggcattcttttacacatcagtcccttcctagtctctgtgcccagtgcaactcctcccaaatcttccttctttccctcctgcctgtcccctcagtcccaaccccaagcgtcactgagtctttctaatcttccttttctacagacccatctgacctctcccctcctcgccaggctgagctaggtcccaattcttccaccctataatctctttatcgcctcccctcctcacacctggtccagcttacagtttctttccgtgactagccctcccccacctgcccagcaatttactcttaaaaaggtggctggagccaaaggcatagtcaaggttaatgctcctttctctttatcccaaatcagatagcgtttaggctctttttcatcaaatataaaaatccagcccagttcatgactcgtttggcagcaaccctgagaagctttacagccctagaccctaaaaggtcaaaaggccatcttattctcaatatacattttattacccaatctgctcccgacattaaataaaactccaaaaattagaatctggccgtcaaaccccacaacaggacttgattaacctcaccttcaaggtgtacaataatagaaaaaacttgcaattccttgcctccactgtgagacaaaccccagccacatctccagcacacaagaacttccaaatgcctgactgaactgcagcagccaggcattcctccagaacctcctcccccaggagcttgctacaagtgccagtaatctgaccaccaggccaaggaatgcctgcagcccaggattcctcctaagctgtgtcccatctgtgcaggaccccactggaaatcggactgttcaactcacctggcagccactcccagagcccctggaactctggcccaaggctctctgactgactccttcttggcttaatggctaaagactgatgctgcccgatcgcctcggaagcccctagaccatcacggatgccgagcttcaggtaactctcacagtggaaggtaagcccgtccccttcttaatcaatacggaggctacccactccacattaccttcttttcaagggcctgtttcccttgcctccataactgttgtaggtattgacagccaggcttctaaacttcttaaaactccccaactctggtgccaactgagacaatactcttttatgcactcttttttagttatccccacctgcccagttcccttattaggctgagatattttaaccaaattatctgcttccctgactattcctggactatagccgcatctcattgctgcccttcttcccaatccaaagcctcctttgcatcctcctcttgtattcccccaccttaacccacaagtataaaatacctctactccttccttcgggactgatcatgcaccccttaccatctcattaaaacctaatcacccttaccccgctcaacaccaatatcccatcccacagcatgctgtaaaaggattaaaacctgttatcactcgcctgctacagcatgggcttctaaaacctataaactctccttaccattcccccattttacctgtcctaaaaccagacaagccttacaagttagttcagaatctgtgccttatcaaccaaattgttttgcctatccaccccatggtgccaaacccatatactctcctatcctcaatagctccctctactacccattattctgttctggatctcaaacatgctttctttactattcctttgcacccttcatcccagcctctctttgtcttcacttagactgaccctgacacccattaggctcagcaaattacctgggctgtactgccacaaggcttcacagacagcccccattacttcagtcaagtccaaattttatcctcacctgttacctatctcggcataattctcataaaaacacacgtgctctccctgctgatcatgtccaattaatctcccaaacctcaatcccttacaaaagaacaaccctttccttcctaggcatggttagtgcggtcagaattcttacacaagagccaggaccacaccctgtagcctttctgtccaaataacttgaccttactgttttagcctagccctcaggtctgcgtgcagaggctgccactgctttaatactgttagaggccctaaaaatcacaaactatgctcaactcactctctacatttctcataacttccaaaatctattttcttcctcataactgacgcatatactttctgctccccggctccttcagctgtactcactctttaagtcccacaattaccattgttcctggcccagacttcaaactggcctcccacattattcctgataccacacctgacccccatgactgtatctctctgatccacctgatattcaccccatttccccatatttccttctttcctgttcctcaccctgatcatgcttgatttattgatggcagttctaccaggccttatcgccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgctcccacccaggactggcaaattagctttactcaacatgtccggagtcagataactaaaatacctcttagtctaggtagacactttcactggacaggtagagtcctttcctacagggtctgagaaggccaccgcagtcatttcttccgttctgtcagacataattcctccgtttagccttcccacctcaatacagtctgataacagaccagcctttattagtcaaatcagccaagcagtttttcaggctcttagtattcagtgaaaccattatatcccttaccgtcctccgtctacaagaaaagtagaacggactaaaggtcttttaaaaacgcacctcaccaagctcagccaccaacttaaagaggactggacaatacttttaccactttcgcttctcagaattcaggcctgtcctcagaatgctacaaggtacagccaatttaagctcctgtatagacgctcctttttattaggccccagtctcattcgacaccagaccaacttagactgtgccccaaaaaaacttgtcatccctactatcttctgtctagtcatactcctattcaccattctcagctactcatacatgccctgctcttgttgacactgccggtttacactgtttctccaagccatcacagctgatatctcctggtgctatccccaaactgccactctaaactcttgaagtaaataagtaatctttgctggcaggactatgctgaatctccttaggcactctctaatcagatgtcctaggtcctcccaattcttagaccttttatacctgtttttctccttttgttattccatttagtttttcagttcatacaaaaccgtatccaggccatcaccaataattctacacgacaaatgtgtttcttctagcatccccacaatatcaccccttaccacaaatcttccttcagcttaatctctcccactctaggttcccacgccgcccctaatcccgcttgaagcagccctgagaaacatcgtccactctctctccataccacccccaaaaattttcaccgccccaacacttcaacactattttatttttcttattaagaaggcaggaatgtcaggcctctgagcccaagccaagccatcacatcccctgtgacttgcacggaaaggaccagaaggcctgaagtaactgaagaatcacaaaagaagtgaaaaggccctgccccgccttaactgatgacattccaccattgtgatttgttcctaccccaccttaactgagtgattaaccctgtgaatttccttcttctggctcagaagctcccccactgagcaccttgtgacccccgcccctgcccaccagagaacaaccccctttgactgtaattttccattaccttcccaaatcctataaaacagccccacccctatctcccttcactgactctcttttcggactcagcccgcctgcacccaggtgaaataaacagccatgttgctcacacaaagcctgtttggtggtctcttcacatggatgcgcatgaaa

SEQ ID NO: 77 - DNA, 823 bp, Homo sapiens
agtgaagaagtgaaatctgggctgcactaaccaatggaaattacttaaaacccttcaccaaacctttcacttaggcattgatagcacccagacgcccaaattattatttactggaccaggccttttcaaaactatcaagcagatagtcagggcctgtgaagtgtgccaaagaaataatcccctgcactgcaggccatacatttcaatccctgtatctttaacctccttgttaagtttgtctcttccagaatcgaagctgtaaaactaaaaatgttcttcaaatggagccccagatgcagtccatgaataagatctaccgtggacccctggaccggcctgctagcccatgctccaatgttaatgacattgaaggcacccctcccgaggaaatctcaactacacaacccctactacacctcaattcagcaggaagaagttagagcggtcgttggccaacctcgccaacagcacttaggttttcctgttgagagggggtactaagagacaggactagctggatttcctagggtgactaagaatccctaagcctagctgggaaggtgaccacatccacctttaaacatggggtttgcaacttagctcacacccgaccaatcaggtagtaaagagagctcactaaaatgctaattaggcaaaaacaggaggcaaagaaatagccaatcatctattgcctgagagcacagtgggaaggataatgactgggatataaacccaggcattcaagccagcaatggctaccctctttgggtcccctccctttgtatgggagctctgttttcactccattaaatcttgcaactgc

SEQ ID NO: 78 - DNA, 765 bp, Homo sapiens
gagagacaggactagctggatttcctaggccgactaagaatccctaagcctagctgggaaggtgaccacttccacctttaaacatggggcttgcaacttagctcacacctgaccaatcagatagtaaggggagctcactaaaatgctaattaggcaaaaacaggaggtaaagaaatagccaatcatctgttgcctgggagcacagcaggagggacaatgatcaggatataaacccaggtattcgagccagcaatggcaaccccctttgggtcccctccctttgtatgggagctctgttttcactctatttcactctattaaatcttgcaactgcactcttctgtgtttgttatggcttgagctgagctttcgctcacagtccaccactgctgtttgccacagtcacagacccgctgctcacttcaatccctccagatcccgcagggtgtccgctgtgctcctgatccagcgaggcacccattgccactcccgatcgtgctaaaggcttgccatttttcctgcatggctaagggcctgggttcatcctaatcgagctgaacactagtcactgggttctacagttctcttccatgacccacagcttccaatagagctataacactcaccgcatggcccaagattccattccttggaatccgtgaggccaagacccccaggtcagagaacacgaggcttgccaccatcttggaagcggctcaccaccatcttgggagctctgtgagcaaggaaccccagtaacaattt

SEQ ID NO: 79 - DNA, 5749 bp, Homo sapiens
gtcaggcctctgagcccaagccaagccatcgcatcccctgtgacttgcacgtatacgcccagatggcctgaagtaactgaagaatcacaaaagaagtgaaaagaccctgccctgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactgtaattttccattaccttcccaaatcctataaaatggccccacccctatctccctttgctgactctcttttcggactcatccggcctgcacccaggtgaaataaacagccatgttgctcacacaaagcctgtttggtggtctcttcacacggacgcgcatgaaatttggtgccatgactcagatcaggggacctcccttgggagatcaatcccctgtcctcctgttctttgctccgtgagaaagatgcacctacgacctcaggtcctcagaccgaccagcccaaggaacatatcaccaattttaaatcaggtaagcggtctcttcttactctcttctccaacgtctctcactgtccctcaaccactttctcctttccactcttcaatctctcccttctcttaatttcaattcctttcattttctgggagagacaaaggagacacgttttatccgtggacccaaaactccggcggcggtcacggactgggaaggtagccttcccttggtgtttaatcattgcagggacgcctctgattattcacccacgtttcaaaggtgtcagaccacgcacggacgcctgccttggtccttcacccttggcggcaagtctcgcttttctggggaaggggcaagtaccccaaccccttctctccttgtctctaccccttctctgctttcctggggcaggggcaagtacccctcaacctcttcttcacccttagctgctagtcccgctttcctagggggcaagaaccccccaatcgcttatttccacgccccaacctcttatctctgtgccacaatcgcttatttccgcgccccaacctcttatctctgcgccccaattgcttatttccgcgccccaacctcatctctgcgccccaatcccttatttccgcgccccaacctcttatctctgtgccccaatcccttatttccgtgccccaacactttctctgcttttctggagggcaagaaacccccaccccttctgcgtgtctctactcttttctctgggcttgcctccttcgctatgggcaagcttccaccttccattcctccttcttctcccttagcctgtattcttaagaacttaaaacctcttcaattctcacctgacctaaaatctaagcgcctcattttcttctgcaacaccgcttgaccccaatacaaactcgacagtagttccaaatagccggaaaacagcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccttcctccccagcctgctccttgccaggccaagctaggtcccaattcttcctcagcctctgctcctccaccctataatctttttatcgcctcccctcacacctgatccggcttacagtttcgttccgtgactagccctcccccacctgcccagcaatttactcttaaaaaggtggctggagagctaaaggcatagtcaaggttaatgctcctttttctttatcccaaatcagatagcgtttaggctctttttcatcaaatataaaaatccagcccagttcatgacttgtttggcagcgaccctgagacgctttacagccctagaccctaaaaggtcaaaaggccgtcttattctcaatatacattttattacccaatctgctcccaacattaaataaaactccaaaaattggaatctggccctcaaaccccacaacaggacttaattaacctcaccttcaaggtgtgcaataacagaaaaaagttgcaattccttgcctccactgtgagacaatccccagtcacatctccagcacacaagaacttccaaacgcaaccaggcgttcctccggaacctcctcccccaggagcttgctacacgcgccggaaatctggccactgggccaaggaatgcccgcagcccgggattcctcctaagccgcgtcccatctgtgcgggaccccactgaaaatcggactgttcaactcacctggcagccactcccagagcccctggaactctggctcaaggttctctgactgactccttcttgacttaccggctgaagactgatgctgcctgatcgcctcagaagccccgtagaccatcacggatgccgagctttaggtaactctcacggtggagggtaagtccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacatctatatctcattgccgcccttcttcccaatccaaagcctcctttgcgtcctcctcttgtatccccccaccttagcccacaagtataagatacctctactccctccttggcgaccgatcgtgcaccccttaccatctcattaaaacctaatcacccttaccccactcaacgccaatatcccatcccgcagcacgctttaaaaggattaaagcctgttatcactcgcctgctacagcatggccttttaaagcctataaactctccttacaattcccctattttacctgtcctaaaaccagacaagccttacaagttagttcaggatctgcaccgtatcaaccaaattgttttgcctatcccccctgtggggcccaacccgtacactcttttgtcctcaatacctccctccacaactcactattccgtgcttgatcgtaaagatgctttcttcactattcccctgcacccctcgtcccagcctctctttgctttcacttagactgaccctgacacccattaggctcagcaaattacctaggctgtactactgcaagacttcatagacagcccccattacttcagtcaagcccaaatttcatcctcatctgttacctatctcggcataattctcataaaaacacacgtgctttccctgctgatcgtgtccgattaatctcccaaacctcaatcccttacaaaataacaactcctttccttcctaggcatggttagtgcggtcagaattcttacacaagagccaggactgcgtcctgcagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacgcatatactttctgctccccggctccttcagctgtactcactctttgttaagtcccacaattaccattgttcctggccgggacttcaatctggcctcccacattattcctgataccacacctgacccccatgactgtatctctctgatccacctgatactcaccccatttccccatatttccttctttcctgttcctcaccctgatcacgcttgattttttgatggcagttccaccaggcctaatcgccacacaccagcaaagccaggctatgctatagtacaagccactagcccacctctcagaacctctcatttcctttccatcgtggaaatctatcctcaaggaaataacttctcagtgtttcatctgctattctactactcctcagggattattcaggccccctcccttccctacacatcaagctccaggatttgcccccacccaggactggcaaattagctttactcaacatgcccgagtcaggaaactaaaatacctcttagtctaaatagacactttcactgaataagtaaaggcgtttcctacagggtctgagaaggccaccacagtcatttcttcccttctgtcagacataattcctcagtttagccttcccacctctatacagtctgatagcagaccagcctttattagtcaaatcagccaattagtttttcaggctcttagtattcagtgaaacctttatatcccttacggtcctctatcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagatgctcctttttattaggccccagtctcattccagacaccagaccaacttagactgtgcccccaaaaaaaacttgtcatccctactatcttctgtctagtcatactcctattctccgttctcaactactcatacatgccctgctcttgtttacactgccagtttacactgtttctccaagccatcacagctgatatctcctcgtgctatccccaaactgccacttttaactcttgaagtaaataaataatctttgctggcaggactatgctgaatctccttaggcactctctaatcagatgtcctaggtcctcccaattcttagaccttttatacctgtttttctccttcttattccatttagtttttcaattcatacaaaaccatatccaggccgtcaccaatcattctacacaacaaatgtttcttctaacatccccacaatatcaccccttaccacgagacctcccttcagcttaatctctcccactctaggttcccacgccgcccctaatcccactcgaagcagccctgagaaacatcgcccattctctctccataccaccccccaaaaattttcgtcgccccaacacttcaacactattttgttttatttttcttattaatataagaaggcaggaatgtcaggcctctgagcccaagccaagccatcgcatcccctgtgacttgcgcgtatacgcccagatggcctgaagtaactgaagaatcacaaaagaagtgaaaaggccctgccccgccttaactgatgacattccaccattgtgatttgttcctgccccaccttaactgagtgattaaccctgtaaatttccttcttctggctcagaagctcccgcactgagcaccttgtgacccccgcccctgcccaccagagaacaaccccctttgcatgtaattttccattaccttcccaaatcctataaaacggccccatccctactccctttgctgactctcttttcggactcatccggcctgcacccaggtgaaataaacagccatgttgctcacacaaagcctgtttagtggtctcttcacacagacgcgcatgaaa

SEQ ID NO: 80 - DNA, 83 bp, Homo sapiens
gtgaggcctctgagcccaagctaagcctgtgacctgcacatatacacccagatggcctggagcaactgaagaaccacaaaaga

SEQ ID NO: 81 - DNA, 972 bp, Homo sapiens
gtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttca

SEQ ID NO: 82 - DNA, 4076 bp, Homo sapiens
gtcaggcctctgagcccaagctgagccatgatattccctgtgacctgcacgtacacatccagatggccagttcctgccttaactgatgacattccaccacaaaagaagtgaaaatggcctgttcctgccttaactgatgacaatgtcttgtgaaattccttctcctggctcatcctggctcaaaagctcccccactgagtaccttgtgacccccactcctgcccgccagagaacaaccccctttttccttcacctatccaaatcctataaaacggccccacccccatctcccttcgctgactctcttttcggactcagcccgcctgcacccaggtgaaataaacagccatgttgctcacacaaagcctgtttggtggtctcttcactcagacacgcaggaaatttggtgccgtgacttggattgggggacctcccttgagagatcaacccctgtcctcctgtcctttgctccgtgagaaagatccacctacgacctcaggtcctcagacctaccagcccaaggaacatctcaccaattttaaatcgggtgagcggcctcttcttactctcttctccaacctctctcactgtccctcaaccactttctcctttccactcttcaatctctcccttctcttaatttcaattcctttcattttctggtagagacaaaggagacacgttttatccgtggacccagaactctggcaccggtcaaggactagggaaggcagccttcccctggtgttgaatcattgcagggatgcctctctgattatttacccatgtttcagaggtgtcagaccatgcagggacacctgcctttgtccttcatccttagcggcaagttccgcttttctgtgggaggggcaagtaccccaaccccttctctccgtgtctctacaccttctctgcctttctggggggcaagaaacccccaaccccttcttcttcacccttagcagcaagtcccgcttttctaggggagggataattaccccaaccccttatatctctgtgccctgatcccttatttccgtgccccaagctcttatatctctgcaccccaatcccttatttccatgccccaacctcttatatctctgcaccctgatcccttatttcctcgcccaacctcttatatctctgtgccccaatcccttatttccgtgccctgacctcgtatctctgtgccccatcccctttcccacttttctggagggtaagaacccccgaaccccttccctccgtgtctctactctctcttttctctgggcttgcctccttcactatgggcaaccttccaccctccattcctccttcttctcccttagcctgtgttcttaagaacttaaaacctcttcaactctcacctgacctaaaatctaagcatcttattttcttctgcaatgccacttgaccccaatacaaactcgacagtagttccaaatagccagaaaacggcactttcgatttttccatcttacaagatctaaataattcttgttgtaaaatgggcaaatgatctgagatgcctgacgtccaggcattcttttacacatcggtccctctctagtctctgttcccaatgcaactcatcccaaatcttccttctttccctcctgtctgtcccctcagtcccaaccccaagcgtctctgagtctttctaatgttccttttctacagacccatctgacctctcccctcctccccaggctgctcctcgccaggccgagctaggtcccaattcttcctcagcctccactcctccaccctataatccttttatcacacctcccctcctcacacctggtccggcttacagttttgttccatgactagccctcccccacctgcccagcaatttactcttaaaaaggtggctggagctaaaggcatagtcaaggttaatgctcctttttctttatcccaaatcagacagcatttaggctctttttcatcaaatataaaaatccagcccagctcatgactcgtttggcagcaaccctgagatgctttacagccctagaccctaaaaggtcaaaaggccgtcttattctcaaaatgcattttattacccaatctgctcccgacactaaataaaactccaaaaattaaattccggccctcaaaccccacaacaggatttaattaacctcgccttcaaggtgtacaatagtagaaaaaagttgcaattccttgcctccactgtgagacaaaccccagccacatctccagcacacaagaacttccaaatgcctgaaccgcagcggccagacatttctccagaacctccttccccaggagcttgctacaagtgccagaaatctggccacaaggccaaggaatgcctgcagcccaggattcctcctaagccgcgtcccatctgtgcgggactccactggaaatcggactgtccaactcacctggcagccactcccagagcccctggaactctggccgaaggctctctgactccttcccagatcttcttggcttagtggctgaagactgatgctgcccaatcgcctcgaaagccccctagaccatcacggacgctgagcttcaggtaactcacacagtggagggtaagtccgtccccttcttaatcaatacggaggctactcactccgcattaccttattttcaagggcctgtttcccttgcttccataactgtggtgcgtattgacagccaggcttctaaacctcttaaaactccccaaatctggtgccaattagacaatactcttttaagcattccttttagttatccccacctgcccagttcccttattaggctgagacactttaactacattatctgcttccctgactattcctggattacagttacatctcatggctgcccttcttcccaatccaaagcctcctttgcgtcctcctcttgtattcccccaccttaacccacaagtataagatacctctactccctccttggcaaccgatcatgcaccccttaccatctcattaaaacctaatcacccttaccccgattgatgccaatatcccatcccacagcatgctttgaaaggattaaagcctgttatcactcgcctgctacagcatggccttttaaagcctataaactctccttacaattcccccattttacctgtcctaaaaccagacaagcctttcaagttagttcaggatctatgccttatcaaccaaattgttttgcctatctaccccatggtgccaaacccatacactctcctatcctcaatacctccctccacaatccattattctgttctggatctcaaacatgctttcttcactactcctttgcacctgtcatcccagcctctcttcgctttcacttagactgaccctgacacccatcaggctcagcaaattacctgggctgtactgccgcaaggcttcacagacagcccccattacttcagtcaagcccaaatttcatcctcatctgttacctatctcggcataattctcataaaaacacatgtgctttccctgctgattgtgtccgattaatctcccaaacctcaatcccttacaaaacaacaactcctttccttcctaggcatggttagtgcggtcagaattcttatacaagagccaggaccacaccctgtagcctttctgtgcaaacaacttgacctgttttagcctagccatcatgtctccgtgcagtggctgctgccgccctaatacttttagaggccctcaaagtcacaaactatgctcaacttactctctacatgtctcataacttccaaaatctattttcttcctcatacctgacacatatactttctgctccccagctccttcagctgtactcactctttgttaagttccacaattaccattgttcctggcccggacttcaatccggcctcccacattattcctgataccacaactgacacccatgactgtatctctctgatccacctgacattcaccccatttccccgtatttccttctttcctgttcctcatcctgatcatgcttgatttattgatggcggttccatcaggcctaattgccacacaccagcaaaggcaggctatgctatagca

SEQ ID NO: 83 - DNA, 10042 bp, Homo sapiens
ttggagtaggtagttaggcagacatgaacatcagaagaaaagcccatcccccaccagtaatgtcaggcaaccattaggtgatggtcaggtagttgttaagcagtctttttaaaataataattggttgcagtcagtgccagagaaaggcagtctcccaatatatggaaaacacttgaagccggtggccaacagcttcccaataaggagctgagcaagcagtctcaagcatgcactaagaggcaaaatggcagagtttaactggtgtatgaccagttcctctaggaacacttgactggcaagggaaaaacgcctcaagtgagcatgcacacaacttcagtaaatacactgtgcatgtggccgctcacaagtgctggcaggccactgtgcatgtggatggcccaccccaaggaaaaatcaagagtggagagacacaaaactccagaagcatgccaacatataaaaccccaagtcaaaggtcaaacagggcacttggatttctcaggttgccaacttggccctcttccaagttactttactttctttcattcctgctctaagagtttttaataaactcttacttctgctcaaaaacttgccttggtctctcactctcgcttatgcccctcagacaaattctttcctttgaagaggcaagaaacaagttcttgcagacccatacagattcactgctgctaacatactttgatgccacatggcttggatacgttccccagtggtaagaaatctctatgcctctccttctttggctggagaagaaggagatctgtacacagttttcttctcccctttcactctcctgccttccaaccaattcccagaactattactctcagccacagtggctctgcacccgctggctgatctctcagcttaccctgaccggtggcttacaggggtaggaaggaccttggagtccacaccatgtagacctgaaatactaatggccctcctagacaggaggctcatgagagtggtagggctaaagcctaacactgtgcaatgtctgcaatttcctctgctttttcaaatacaattgtctttttccccaaaacccacaccacctattctcctgttttctctgtgtgtgttctgaaacggccttgtgtgcccaccacactgtctacctcaggggcaagtctgtctctcttctttcactttgtatgccacgcaacttccttctctacgttaaacacacactccctgttattcgttcacccatggctcttgttgcatttgtacagcagcagagaaacaggctcccttgcagatgtccattggctcattgccaggatagacactaattagaaccccagttcttccagctccttatgacttaccatacacttttcatccctgttatgctccagggtcaagtttttggtggcttttgaagcagtttttatggctgcataggacatcactctgtggttctttaaggatctcacctacttgctttttttgagttagcaccccctttgggaggagagaaaattcttcctttgccatttgtgggctcttatcccaagctccgagttctccaaagattcctctttatgtcaagagggcaaataaacattgctgttttgaatcccagggctgctgtttatgtgagcatatgaaggttttccgtcagtattcctcatgcttcctcccactttctcctatagcagaggggttgtcctgtctactcaagcatttcttctggatattaccccaggaggacagggaacctctaatacaaaattttctccattcctctaatcacttccataccctcctcaatgtgcttaaggactctcaaggtcatatttaaagggagggaagtgcagcctcttgcagcagttggctgaaaaacaagcttctcatctacttaaagaacatgggaaatggattataaaaaaaaaagaggtaatcattttgttgccagaatgctgtgagtaagagtcactataagatcatggagataaggatataggccagcccaaggctgcaggtgcaagagacaaagtacccataggacagagagagataaaggctggtcacaggccacaggcacagaacagattaccattagaacagagatgaaggcaagcttaggggtacctggtaagaccggtttattctgaaactccaaggataaataggggacccctgttcacttgggtatttcctctgttctcaagtgggtaattgtgatgagatgggacacaggtttgggtacccagtaagacaggttcattctggaaccctaaggatgaatgggggatgccctgttcaggaaaggataatagggaaataaaaggagataccttctttttcctttttttctcctttgttgtatcttcacagatgggtaatcacatctccctactacagtacaaaccctttggatgcatcctcaagaactgaaagtttgaccccaaaaccctgaaaaggaaaaggctaatatttttctgtatcacagcctggttttaatacaagctccaggagcaggaatcttgaccagaaagtggaagcataaattttaaatttttaatatgctctatcagctagatctgttttgccactagcagggaaaatagacagaaatcccctatgtacaggccctaagaaacaacccagacctttgttgggcttgtaaaattgatccagtgatgatagcagccataatcatgctgccccatctggttggttcgggagacccctcattgggtttacccagggctcaagccctggaggaaccaagagtggagcttagctcaaaccctaccctttggccccattatatccaagtctcctggccctggagccttcccttccctacccagggccatcctctggacaccaccccctcaagttatgctcccttcaagaagttagttgacctactagagttcagactccatttaatatgcaagacctgagtcaaattaaaacagaactagggaagtttatggaggatcctgacaaatgcatcaaagggttccataaactgggcttaacatttgaactcacttggagggatctctcagtcatactgggacaaaccctgtctaagggagaacatgactccattatggaggcaccccaaaaatttgcaaatgcaatacacatgactgaccttggtggctaccctgtatgggccaccacagttcactgggtcagccccaattgggattacaatacccatgggggcatatgggcaaagaattgcatgttcttatgtctcgtagaaggaatgaaagctagaagagccaagcctgtaaactataataaaattggtcttaatagatcaaggacctcttggaaaccccaccactttcctagagaggctacaagaggccctggtgaaacacactaacctagacccagagacatcacaagggcaactggtcctgaaggaccattttttaactcaggcagccccacatatttggaggaaactctaaaaactagcactggaccccaaaacccttatgcctgacatcttcaacatagcttcctctgtcttttacaaccaggactaggagaaagaggaaagggctcagggaaagaagaggtaaaaggaaaagcagcagctccaactattggctgccctaaaaatccaccagccctctccaagttgccctcagaatactctcccagttaactgccatcagtgtgggaagccaagacactggaagacaaactgccgcagtgggacagatgggaaaaatccctacatggcttgccctttctgtcacaaactcaaccactggaaatggaactgccctgagggctgaagggcccctagaacagaatcccaattcctgatggccttaagctgaaaaggcccgccactccagcagctcctggactgaacattactattgaagggacagagctaagggctgctttggatgtggcaggtaggactataagttttctttgggaaatggccttcttggtgcttatgtcttcatgggcaattatcctccaaggtgatggggttaaattgggtgcccataacccaaaggttcactcctcatctttgctgcctgtgaggggagactgtcttttctcattcatttttaatgatagcagaatgtcctacactgcttttgggtagagatattttatttagactaggggcttagttaaccttttccaaatgcaatcttatgcctcaaggaagtcacacacaaggatgaacttcccagacttttccattaatccagaagtctggggctcaagaatatcaggaaaggtcataatgataatgcctatagtaactcagctcatggatccttctagctaaccttgtagaaggcagcttcctctttgacctctggccaaaagggacttcatcccctaattgaaaaatgtctaaaacatggattattaatatactataactcgctatgtaacacccctgtcttacctgttaaaaagagcaatggagcaatggacaatataggctagtccaggacctgcaaatcataaatgaggcagtagtcccaatacacccaatggtccccaacccatatattattctaggagaagtacccccagatgctcatttgttctcagtcttagagctcaaagatgctttcttttgtgtctccctagactcatcctcccaatttgtatttgcacttgaattggggaatgaaaaaggaaggagtctacagctaatctggatagtacttccgcaaggttccagagatggttccaatttgtttgggcaagtcttggctagagatttgcaggacctaactcttgagggttgagggtgtctcctacagtacatagatgacagatgacctgttaatctgctcccctacaagagagttatgaatcctgcatctagtccagacactagattttctcacagagggtacaagatgtctaaggccaaggcacatcgattaagaaaagaggtttaatacctggggataatcctgatcccacagagaacataagctttctccagaatggatacaggccatccttagaatacctaccccaaccacctaaaagcaactttgggcttttctggggatcacaagatattccagactttcaatactggcatatggtggaattattaagtccttatatcaggttctaaaagaagggactcatcaggacccacttctctgggaaaaagatcagaagcaagcctttagagaactaaaaactgccttctcacaagccctagcccttgggctacccatactaaccaaaccgtttcagcttttcatcactgaaagtaagctgtagccctggaagttctaactcaaaccatcaggccatcaaatgtcctataggttactttttaaagaacctagacccagtagtgcaagggtggccacactgcctaaaggtagtggctgcagcagcccttttacccaaggaggccctcaaaatcacaatgggacagtcggtcaggctcctgacattccaactaataggccccttattggatataaaaagaccgcaatggatcactgacaacagactgctaaactaccaagtcttgttgtcagaaaacccacaggtaacagttgagtggtgttccactcttaacccagcctccttactgccactactagaagaggataactgaacacattcatgttgtgagatacttaaccaaatttatgccagccaggaagacttacaatatcagcccctaggttatctagatgaaatatggttttcagataggattggctttgtcaagaatggagatagatatgcagggtatgctatatgtcccttcacccagttacagaggtggtagctctgtccctggggacctcagtgcaactagctgacccatcacattgaccagggccctaaaacttggggaaagaaaaagaataaccacatatacagattccaaatatgccttcctggtgcttcacacccacatggctaaccagaaggaagggggatacctaacagcttggaatactcctattacatagagacctccaatcttagagctactagaggctgttcatttgcctcaggaagtggcagcagtgcactgtaaagaataccacaggggttctgatgaaactgcatggggaaatatgttatctgaccaaaaagctaaagaggcagccatctcaaaagacacctctgtggggactttactcccctctctccccagtgaactgcccttctccaatacactaaggaagaaatagattgggccatccagcatgggtataaagaagaaaccaatggatggtacatgttgggagaacttctccatctacctaatgcttcccagtggaaagtcatcaagtgtttacttgactcatgccaccttgaaaaggacagtctagggtaaatttgtaaatgggtgttcagtgggaagggactaaccaaaattattcaataggtttgtcaagcctgcaccttgtgaaccacaaataatccctagatggggaagccccctccataataagtcaaatccaaaggagaggtacatactctggggaggactggtagatggacttcactcagctacccacatgccacaggtgtaagtacctcttggtctgtgtaggtaccttcacagaacgggaagactcctgccccacaaggactgaaaaggcacaggagatagctgacttgctcctaaaggaactcattccctgctttgaactccccaggtcattgcagagtgacagtgattcatctttttttccccaagtaacttaacaggttagtaatgccctaggcatgaagtggtaccctcactttgcctgagaactgcaatcttcaggaaaagtggaaagaatttaccaaaccctgaaatgcatcctcaataatctctgtcaggaaatagcagtcatgggtggacctcttacctttaaccctccttcaaatctgtattgcccctaaggctccctagcaattaagcccctttgagatcttatattgtaggccatttctatattcagacttatctgatactagatgaagaaactgccaaaatcacccagtatgtttcttctttagcaggcttccaacagactctctgggaatatgggttaaaaacaaacccaacgtcggaaggggaaacaatcccagcctctgtatcttccaggctctagttctcattaaagcttggaaggttgaaaccccaaattcctaactaactgtattctgggggggccacttcactgctccagtatctattcccacagccattaaagtaccagagatagccagctggatacatcatgcctgggtgaagtcatggaaaggccatgcaacaccagagccagaaccaacaccctcagctccagaatacacttgtgaggcactggaagacctgaaattcctcttttagtgaaaacataagtaatgccccctcaacatcctttcacctcaaagtaaggtgatcctagtattaggaattttactaacaattgttatgattattatcactattttaatcccaacttgtacaccaccaggagttccagtggcagcttgctttgtgatcaatttctctctctcacaatcaccttaggtcaccatggctctgctcctgttggttctcatactcaacgctttactggcagcacactgccatcctgatttcctgttatgagaaaaagctcagcaattgctccaaaacacaggatccccttactccaccaaatgctggttatgtactagctcttcctctaaaacaccagggagagcttatccagcctgtaccagagattggacaagcatagacatagagttacgtatttcctctcaacaggaccctaatctgaaagagctatttgggtctgcaaataacattttttgcaaaagcaaagcagtatttacttgacatccacaaggcacctctcatttttggatcaatcttttctaatatcactttaatgggaataacctctatttgtcttatggccaaaagaaaaagatggattggatgtaggctctttcccagtatagcttgtaatgttactctctctgtagattctaaccaacagactgatggaacatacaccgaaaaccaattccaccatcaaccaagattccccaaaccttcaaatattatctttcttcaggcaactttgctaattaagtccattcagttttgccagcaatgcccaagctcatgcagtacttgaaatttctagttccagcctgatgattataaccaatgtctgcaaattgccaacctcagctccacagcagaatgggttctaatggagtaaactcaaaattctctttttttgggaaaatgaaaccaagggagctaatcagagccaaaccccatgtacccaagtgttagcaggcatgaatgtagctaccagctacctgggtgtgttgtcatccttggtatttttgggggctgtcctcatctcttcttttgttttgacatctctacttgtcttaaaacccaaggagccttctgtgtttgtggccaatcagtttaccaatgcctcctcattaaatggactggaacttgtaccatagattatgtacccctggacatctttatactccctggcaatctctctcttccagcaccaatccatgggaattctatcttgcccagggtgaaaagggctatccaattaattccccttcttatgggcctcagcattatagctggtatgggaacctaaactgccggaatctcaaaagcctccttgacctatagccaactctgaaaggaaatagccagcaagtttaatatcatggctaaaacctcaaccatggccagagcaaattaacactttagcagttgtagtcctccaaaactgtcaaggactagatatgttaatggcagcacagggaggaatttgtttagctttagatgaaaaatgttgcttttgggtaaatcaatcagtaaaagtacaaaacaacatcagacaactcctaaatcgagcctccagcttacaagaacaagcctctcgtggttagttagattggtaaggaacctggaaatgggatcttccctgggttcttccctttttaggcccacatgttagcctctacttttgctcctttcagtccatgtcttcaaaaatctaataacccaatttgtctcctttctctcacctttagatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctagcaagaggccaagacccacagaacaatcaccatcacacctctgtcagcaggaagcagttacagaagactgaccttcatccagtttcccaaagaattgggtcatggatttttgcgggggaaaatgttagagtaggtaattaggcagacatgagtaagggaggagagaccccctccaactaggaatgtcaggtgagcatcagatgatcatcaggtggttgttaaactctctctctaaaataataataggttgcaactggcagcagggaaagacaatctcccaatagatagaaaagtcctgaagctggtgatcagcagcttcctagtaagatctcaggatttgggcaagcaggctcaaacatgggcactaagaggcaaaatcgtggagtttaactggtatacagacttcctctaaaaacacatgactcatgcacatgtggacagcctgccccaaggaaaaatcaaaagaggagagatgcaaaaccccagaagcatgccaatatataaaaccccaagtctaaggtcaaacagggcacttggatttctcaagttgcccacttggccctcttctaagtgtactttatttcctttcattcctgctctaaaactttttaaatttcactcctgctcaaaaacttgcctcagtctttcactctgccttatgccccttggaagaattatttccttcaagatggcaaaaagcaagctgctgcagacccatacagatttgctgctgctaa

SEQ ID NO: 84 - DNA, 5599 bp, Homo sapiens
tgactcctttttcagactcagcccgcctgcaccaggtgaaataaacagccttgtggctcacacaaagcctgtttagtggtctcttcacacagacacgtgagacacttggtgccaaagacccgggtcagtgggactccttcgggagaccagtcccctgtcctcaccctcactccatgaagagatccacctacaacctcgggtcctcagaccaaccagcccaaggaacatctcactgattttaaattgggtaagtggcctctttttactctcttctccaacctctctcactatccctcaacctctttctcctttcaatcttggagccatccttcaatctctcccttctcttaatttcaattcctttcattttctggtagagacaaaggagacaccttttatccgtggacccaaaactccggcgtctgtcacggactcgggaagacagcctttccttggtgtttaatcactgcggggatgcctctctgattattcgcccacgttccattggtgtctgatctccgcagggacgcctgccttggtcattcacccacattcccttggtggcaagtcaattgcagggacacctgctttggctgctcacccacgctgcagcctggggctgctgcccgccccctttctccgtgtctctacccttctctttaaacttgcctccttcaccatgggcaaccttccacccttcattcctccttttcccttagcctatgttctcaagaacttaaaacctcttcaactcttgcctgacctaaaatctaagcgtcttattttcttctgcaacactgcttggccccaatacaaacacgacaatggttctaaatggccagaaaatggcacttttgatttctccatcctacaagacctagataatttttgtcaaaaaatgggcaaatggtctgaggtgcctgacatccaggcattcttttacacgtcggtccctccctagtctctgctcccaatgcgactcatcccaaatctttcttctttctctcctgtctgttccttcagtctccaccccaagctctgagtcctttgaatccttcttttctatggactcatgtgacctctccccttctccccaggctgctcctcgccaggccaagccaggtcccaattcttcctcagcctctgctccccgaccctataatccttctatcacctcccctcctcacaccggtctggcttacagtttcattccgtgactagccctccccaacctgcccagcaatttcctctttaaagggtggctggagctaaaggcatagtcaaggttagtgctcttttttctttatcccaaatcagatagcgtttaggctctttttcatcaaatataaaaacccagcccagttcatggcccgtttggcagcaaccctgagatgctttatagccctagaccctgtaaggtcagaaggccgtcttattctcaatatgcattttattttattacccaatctgctcccgatattaaataaagctccaaaaattatgaaaccccacaacaggacttaattaacctcgccttcaaggtgtacaataatagagtagaggcagccaagtagcaatgtatttctaagttgtaattccttgcctccactgtgagacaaaccccagccacatctccagcacacaagaactccaaacacctgaaccgcagctgccaggggttcctccagaacctccccccaccccaggagcttgctacaagtgccggaaatctggccactgggccaaggaatgcccgcagcccgggattcctcccaagccatgtcccatctgtgcgggaccccactggaaatcggactgtccaactcgcccggcagccactcccagagcccctggaactctggcccaaggccccttcccagatcttctcggcttagcggctgaagactgacactgcccgatcgcctcggaagcctcctggaccatcacagatgctttaggtaattcttacagtggagggtaagtccatccccttcttaatcaatacggaggctacctactccacattaccttcttttgaagggcctgtttcccttgcctccataactgttgtgggtattgacggccaggcttctaaatctcttaaaactccccaactctggtgccaacttggacaacattcttttatgcactcctttttagttatccccacctgcccagctcccttattaggtcaagacattttaactaaattatctgcttccctgactattcctgggctacagccacacctcattgccgcccttttctccagttcaaagcctccttcacatcctctccttgtatctccccaccttaaaccacaagtataggacacctctactccctccttggtgaccgatcatgcaccccttaccatcccattaaaacctaatcacccttaccctgctcaatgccaatatcccatcccacagcatgctttaaaaggattaaagcctgttatcactcgcctgttacagcatggccttttaaagcctataaactcttcttacagttcccccattttacctgtccaaaaaccggacacgacttgcaggttagttcaggatctgtgccttatcaaccaaattgtcttgcctatgcaccccatgatgccaaagccatatactctcctatcctcaatacctccctccacaacctctccacaacccagtattctattctggatttcaaacatgtcttctttactattccttgcacccttcatcccagcctctctttgctttcacttggactgaccctgacacccatcaggctcagcaaattacctgggctgtactccacaaggcttcacagacagcccccattactttagtcaaacccaaatttcttcatcatccattacctatctcgacataattctgcatgaaaacacacgtgctctccctgctgatcacgtccggttaatctcccaaaccccaaccccttctacaaaacaacaactcctttccttcctgggcatggttaggtacttctgcctttggatatctagttttgccatcctgactaaaccattatataaactcacaaaagcaaacctagttgaccccacagatcctaaatcctttccctactcccctttccattccttaaaaaacagccctaaaagctgctcccacactggctctccctaactcatcactcccttttcattacatacagccgaagtgcagggctgtgtggtcggagttctcacacaagagccgggactgcgccctgtagcctttctgtccaaacaacttgaccttactgttttagcctagccctcacgtctgcgtgcagtggctgccgctgccttaatacttttagaggccctcaaaatcacaaactatgctcaactcactctctacagttctcataacttccaaaatctattttcttcctcacacctgacacatatactttctgctccccggcttcttcagctgtactcactctttgttgagtctcccacagttatcgtcgttcctggcccggacttcattccagcctcacacattattctggataccacacctgacccccatgactgtatctctctgatccacctgacatccactccatttccccatgtttccttcattcctgtttatcaccctgatcacacttggtttattgatggcagttctaccaggcctaatcaccactcaccagcaaaggcaagctatgctatagtatcattcaggctaccgctctgcccccctccactacctctcagcaagccaaactgactgccttaacttgagctctcactcttgcaaagcgactatgcgtcaatatttatactgactctaaatatgcctttcacatcctgcaccaccatgctgttatatgggcagaaagaaatttcctcactaggcaagggtcctccatcattaatgcctccttaataaaaactcttctcaaggcccctttacttccaaagaaagatggagtcattcactgcaaaggccatcaaaaggcatcagatcccattgctcaggacaatgcttatgctgataagatagctaaaaaagcagctagcgttccaacttgtatccctcacggcagtttttctccttctcatcgggccactcccacctactccctcgctgaaacttccacctatctcttcccgcacaaggcaaatggttcctggaccaaagaaaatatctccttccaacctcacaggcccattctattctgttgtcatttcataacctcttccatgtaggttacaagccgctagcctgcctcttagaacctctcatttccttttcattgtgggaatctatcctcaaggaaatcacttctcagtgttccatctgctattctactactcctcaagaatttctcaggccccctcccttccctacacatcaagttcggggatttgcccacccaggactggcaaattgaccttactcagatgcctcgtgtcaggaaactaaaataactcttggcctgggtagacactttcactggatgggtagaggcctttcccacagggtctaagaagccactgcagtcatttcttcccttctgtcagacataattcctcggtttgggcttcccacctttatacagtccaataatggaccagcctttactagtcaaatcacccaagcagtttctcaggctcttggtattcagtggtgcctggttttacctcaaactgccacccttaagtctctaagtggatagaagatcttcagtgacaaagtaccctccaacagtttcaccctgatgaagtcctgttctttacttttatgcttactcttattctcattcccattcttatgccaccctctacctctctccagctatctccaccacactatcaatctcagtcactctctcctagccatttctaatcctttttgctggctttgtatttctctttcctccaaaatcaccaaggtattgacttactcactgctaaaaaaaaagggggactctatgtttttaaatgaagagtgctgtttttacctaaatcaatctggcctggtatatgacgacattaaaaaaaactcaaagatagagcctaaaagcttgccaaccaagtaagtaattacgctaaccccgcttggacccccttggacactctaattggatgtcctgggtcctcccgattcttagtcctttaatacctgtttttctccttctcttattcggacctcgtatcttccgtttagtttctcaattcatccaaaactgtatccaggccatcagcaatcattctatatgacaaatgtttcttctaacaaccccacaatatcaccccttaccacaaaatcttccttcagcttaatctctcccactctaggttcccacgccgcccctaatcccgctcgaagcagcactgagaaacatcgcccattatctctccatacaacccccaaaaattttcgccaccccaacactttaccactattttgttttatttttcttattaatataagaagacaggaatgtcaggcctctgagcctaagccaagccatcatatccccagtgacctgcagtatacatctagatggcctgaagtaactgaagatccacaaaaaggagtgaaaatagccttaactgatgacattccaccat

SEQ ID NO: 85 - DNA, 6195 bp, Homo sapiens
gacagacaggaccagctggatttcctagactaagaattcctaagcctagctggggaaggtgaccgcgcacccacctttaaacacggggcttgtaactcagctcacacctgaccaatcaggtagtaaagagggctcactaaaatacaaattaggctaaagcaggagataaagaaacagccaaatcatatatcacctgagagcacagggggagggacagtgatcgggatgtaaacccaggcattcgagcagggagcagcaaccccctttgggtcccctcccattttatgggagctctgttttcactctattaaatcttgcaaccgcacactcttctggtccatgtctgttacagctcaagccgagctttcactcgccatccaccactgctgtttgccgccatcgcagacccgccactgacttccacccctccggatatggcaggatgtcttctgtgctcctgatccagcaaggcgcccattgctgctcccaatcgggctaaaggctccccattgttcctgcgtggctaagtgcctgggttctcctaatcgagctgaacactagtcgttgggttccatggttctcttctgtgacccacagcttctaatagagctataacactcaccgcatggcccaaggttccattccttggaatccatgaagccaagaaccccaggtcagagaaaaagaggcttgccaccatcttggaagcagcccaccaccatctcgggagctctaagaacaaggaccctcccagtaacattttggtgaccatgaagggacatccaaagtggtgagtaatattggaccacttttacttgctattctgtcctatccctaccatacaaaggtctgaccagacctaggaggaactcccttcaggacaggacgatagatggttgctcccaggtgattgagaaaaaaaccacaatgggtattcactaattgatagggagactcttgtggaagcagaattaggagaattgccaaataattggtctgctcaaacgctggagctgtttgcactcagccaagccttaaactgcttaaagaatcaaaaaactctatctcaatcctgactcaaaaggttacctacaccctctctgaaacgaatttgcataagaactgttgtttgtgggaatgcatcttaatggggcaactgggttgttatgaaatactctggaacccaccccagctctaggactcaccactgagcacaaaggcaatgttgggcatgctggtaaaggaccactggagtccagcagcccagacccctttctttgtgatcaaggaaggtgggaaaaggggtgcaggactgctacatggtgagtgtaactaatccgataagcagaggtccatgggtggttatgcaccctggaaaggaataagcattaagaccatagaggacgctctaggactaatgctcatcggaaaatgactaggggtgctggcatccctgtgatttttttgttttgttttttgttttgttttttttttcagatgggaagcattccccctaaggcaaatgcccctaagatgtattctggagaatttggcccagtcagagtgtatgtacctttttccctgtcagacttaaagcaaattaaaataggcctaggtaaattctcaaataaccctgatatctatattgacattttacaagggttaggacaaaactttaatctgacatgagagatataatgttactgctagatcagacactaaccccaaataagagaagtaccaccataactgcagcccacgagtttggcgatctcgggtatctcagtcaggtcaatgaaaggatgacaacagaggaaagagaacgattctccacaggccagcaggcagttcccaatgtagaccctcattggaacgcagaatcagaacatggagattagtgcagcagacatttgctaacttgcgtgctagaaggactaaggaaaactaggaagaagcctatgaattattcaatgatgtccactataacacaggaaaaggaagaaaatcctactgcctttctggacagactaagggaggcactgaggaagcatacctctctgtcacctgactctattgaaggccaactaattttaaaggataagtttatcactcagtcagctgcagacattaaagaaaaacttcaaaagtccaccttaggcccagagcgaaacttaaaaaccctattgaacttggcaacctctgttttttataatagagatcaggaggagcaggcggaacgggacaaacgaggtaagaaaaaggccaccactttagtcatggccctcgggcaagcggactttggaggctctggaacgcggaaagcctgggcaaatcgaatgcctaatagggcttgcttccagtgcggtctccaaggacactttaaaaaagattgtccgaatagaaataaaccgcccccttgtccatgccccttatgtcaagggaatcactggaaggcccattgccccaggggatgaaggtcctctgagtcagaagccactaaccagatgatccagcagcaggacagagggtgcccggggcaagcgccagcccatgccatcaccctcacagagccccgggtatgtttgaccattgagggccaggaggttaaccatctcctggacattggcgtggccttcttagtcttactctcctgtcctggacaactgtcctccagatctgtcactatctgaggggtcctaggacagccagtaactagatgcttctcccagccactaagttgtaactggggaactttactcttttcacatgcttttctaattatgcctgaaagccccactcccttgttagggagagacattctagcaaaagcagaggccattatacacctgaacacaggagaaggaacactcgtttattgttccctgcttgaggaaggaattaatcctgaagtctgggcaacagaaggacaatatggatgagcaaagaatgcctctcctgttcaagttaaactaaaggattccgccccctttccctaccaaaggcagtacccccttagacctgaggcccaacaaggactccaaaagattgttaaggacctaaaagcccaaggcctagtaaaaccatgcagtagcccctctgatactccaattttaggagtacagaaacctaatggacagtggaggttagtgcaagatctcagtattatcaatgaggccattgtccctctataccaagctgtacctaacctttacactctgctttcctaaataccagaggaaggagagtggtttacagtcctggaccttaaggatgctttttcctgcatcctgtatatcctgactctcaattcttttttgcctttgaagatccttcgaacctaatatctcaactcacctggttcacggatagcccccatctaattgtccaggcattagcccaagacttgagccagttttcatacctggacactcttgtcctttggtacatggatgatttacttttagccacccattcagaaaccttgtgccatcaagccacccaagcactcttaaatttccttgccacctgtggctacaagatttccaaaacaaaggttcagctctgctcacagcaggttaaatacttagggctaaaagtatccaaaggcaccagggccctcagtaaggaatgtatccagcctatactggctcatccttatcccaaaaccttaaagcaactaagagggttccttggcataacaggcttctgccgaatatggattcccaggtacggcgaaatagccaggccattgtatacactaattaaggaaactcagaaagccaatacccatttagtaagatggacacttgaagcagagcagctttccaggccctaaagaaggccctaacccaagccccagtgttaagcttgccgacggggcaagacttttctttgtatgtcacagaaaaaaacaggaatagctctaggagtccttacacaggtccaagacaccagcttgcaacctgtggcatacctaagtaaggaaaatgatgtaacggcaaagagttggcctcattgtttatgggtagtggcagcaatagcagtcttagtatctgaagcagttaaaataatacagggaagagatcttactgtgtggacatctcatgatgtaaacggcatactcactgctaaaggagacttgttgctgtcaggcaaccgtttgcttaaatatcaggctctattacttaaagggccagtgctgtgactgcgcacttgtgcaactcttaacccagccacatttcttccaaacgataaaagatagaacataactgtcgacaggtgattgctcaaacctacaccactcgaggggaccttctagagtttcccttgactgatcccaacctcaacttgtatactaatggaagttctttgtagaaaaaggacttcaaaaagcagggtatgcagtggtcggtaataatggaatacttgaaagtaatcccctcactccaggaactagcactcagctggcagaactaatagccctcactagggcactagaattaggagaagaaaaaagggtaaatatatatacagactgtaagtatgcttacctacttctccatgaccacgcagcaatatggagagaaagggaattcctaatttcagagggaacacctatcaaacatcgggaagccattaggagattattcttggctgtacagaaacctaaagagatggcagtcttacactgctggggtcatcagaaaggaaaggaaagggaaatagaagggaactaccaagcggatattgaagccaaaagagccacaaggctggaccctccattagaaatgcttatagaaggacccctggtatggagtaatcccctcaaggaaacaaagcaccagtactcaacagaagaaatagattggggaacctcacaaggacatagtttcctcctctcgggagggctagccaccgaagaaggaaaaatagttttgcctgcagctaaccaatggaaattacttaaaacgcttcaccaaatctttcactctcactgcacctcctccatgccgctgtactaccagtagctccccttaccaagagcttctatggagaaatgtggcttcccagaaatattgatgccccattgtataggagtttttctaaaggaaaccccactttcactgcccacactcatatgcccttgcacttcaggccatacatttcaatccctgtatctttaacctccttgttaagtttgtctcttccagaattgaagctgtaaaactacaaatggctcttcaaatggagccccagatgcagtccatgactaagctctactgcggacccctggactggcctgctagcccatgctctgatattaatgacatggaaggcaccccccctgaggaaatctcaactgcacgacccctactatgccccaattcagcaggaagctgttaacagcggtcattggccaacctccccaacagctcttgggttttcctgttgagagggggaactgagagacaggactagctggatttcctaggccgactaagaattcctaagcctagctggggaaggtgaccacacccacctttaaacacggggcttgtaactcagctgacacccaaccaatcaggtagtaaagagggctcactaaaatacaaattaggctaaagcaggaggtaaagaaacagtcaagtcatatatcgcctgagagcacagggggaaggacagtgatcaggatgtaaacccaggcattcgagcagggagtggcaaccccctttgggtcccctcccattttatgggagccctgttttcactctattaaatcttgcaactgcacactcttctggttcatgtttgttacagatcaagctgagctttcactcgccatccaccactgctgtttgccgccattgcagacctgccactgacttccacccctccggatctggcaggatgtctgctgtgctcctgatccagcgaggtgcccattgccgctcccgatcgggctaaaggctcaccattgttcctgcatggctaagtgcctgggttctcctaatcgagctgaacactagtcgctgggttccacggttctcttccgtgacccatggcttctaatagagctataacactcactgcatggcccaaggttccattccttggaatccatgaggccaagaaccccaggtcagactacaagaggcgggctgccatcttgggagcagcccgccatcatcttgggag

SEQ ID NO: 86 - DNA, 639 bp, Homo sapiens
accccaggaatgtcaggcaaccaccaggtgacggtcaggcagttgttaaactgtctctctaaaatgataattggtcgcggcccaagccagtgaaaggcagtctcccaacagatagaaaacacctgaagctggtgatcagccgcttccctataacatctcaggagttggacatatgggctccagcatgcgcattaagaggcaaaatggtagcgtttaactggtatatgacttcctagggacattggactgttaagggaagaatacctcaaggaagcatacatacgacttcagtaaacacactgcacaggctcccctcccaagtgctaggccactgtgaatgcagacagcccaccccaagggaagaatcagggcagaagggacacaagaccccagaagtatgccaacatataaaaccctgagtcaaaggtcaaaccacgcactgatctctcacgctgcccacttggccctcttccaagtgttctttacttcctttcattcctgctctaaagctttttaataaactttcactcctgctctaaaacttgcctcggtctctccttctgccttatacccctcagttgaattctttcttctgagagggcaagaactgaggttgccgtagacccatgcagattcacc

SEQ ID NO: 87 - DNA, 8094 bp, Homo sapiens
gtcaggcctctgagcccaagctaagccatcatatccccagggacctgcacgtatacatccagatggcctgaagcaactgaagatccacaaaggaagtgaaaatagccttaactgatgacattccaccattgtgatttgtttctgccccatcctaactgatcaatgtactttgtaatctctcccacccttaagaaggttcttcgtaattctttgtaatcccacccttgagaatgtactttgtgagatccaccccctgcctgcaaaacattgctcctaactccaccgcctatcccaaacctacaagaactaatgataatcccaccacactttgctgactctctttttggactcagcccgcctgcacccaggtgaaataaacagccttgttgctcacacaaagcctgtttggtggtctcttcacacggatgcgtgtgacgtgcgtgacatttggtaccaaagatccgggacgggagtactccttacagagaccggtcccctgtcctcatcctcactccatgaggagatccacgtacaacctcgggttctcagaccaaccagcccaaggaacatctcatgaatttcaaatcgggtaagtggtcttttcactctcttctccagcctctctcgctacccttcagtctccctgtccttccaattccagttctttttcctctctagtagagacaaaggagacatattttatccgtggacccaaaactccggcgccagtcacggactcggcaagacagtcttcccctggtgtttaatgactgcagggacgcctgcctgattattcacccacactccactggtgtctaatcactgtggggatgcctgccttggtcattcacccacattcccttggtggcaagtcaattgcggggacaacctgctttggctgctcacccacattgcagcccacggctgctccctaccccccttctccgtgtctctacccttctctttaaactggcctccttcactgtgggcaacctttcaccctccattcctccttcttctcccttagcctgtgttctcaagaacttaaaacctcttcaactctcacttgacctaaaatctaagcatcttattttcttctgcaacaccgcttggccccagtacgaactcgacaatggttctaaatggccagaaaatggcacttttgatttctccatcctgcaagacctagataatttttgtcgaaaaatgggcaaatagtctgaggtgccttacgtccaggcatttttcagacttcgttccctccctagtctctgttcccactgtgactcatcccaaatcctcctcctttccctcccgcctgtcccttcagtcccaacctcgagcgttgctgagtcttgtgaatcttccttttctgctgacccatctgacccctcacctcctccccaggctgctcctcctcagctcgctccccgccaggctgatcaggctccagctcttcttcagcctctgctccccaccctataacccttctattacctccctcccacacccggtccggtttacagtttctttctgcgaccagctctcccccatctgcccaacaatttcctcatagagaggtggctggagctgaaggcatatgtcagggtacatgtgcctttttctctatcagacctttcccaaatcagccagcgtttaggctctttctcatcagaccccactaaatacatacaggaattccgatatctaactctgtcctacagtttaacctggagtgactgaaatgtcatcctaacttctaccctctccccagataaatgggaaagagttttttctctagcccaatctcacactgacaaccaccggcttcacgagccagacctccaggagggcatcagagcagttccccgagaagatccccagtggaactaccaggcagattccccaggtatagctacgcgagattacatggtttcctgcctagttgaagggcttaaaaaggcagcttacaaagctgttaattatgacaaacaagaaactacccgaggtgaagatgaaaacccagcccagttcatggcccacttggcagtaacccttagacgctttaccgccctagacccagaggggccaggaggccgccttattcttaatatgcattttatcacccagtcagctcctgatgttagaaaaaagattcaaaaactggaatccagccctcataccccacaacaggaattaatcaacctcaccttcaaggtgtacaataataggaggtagccagacagcaacgcatttctgagttacagctactcgcctctgctgtaagacagcccacaaccacgtctccagcatacaagaacttcagaacatccaagccacagctcccaggggctccttcaaaacatcctcgtgggccttgcttcaaatgccaaaagcctggccactgggccaaggaatgcccgcagcctgggattcctcctaagctgtgccctgtctgtgcgcgcccccactggaggtcggactgtccgactcacatcgccgctgctcctaaagcacctggagcccaaacccaacgttccttggccaactccttcccagatctcctcggcttagtggctgaagactgacgctgcccatcgcctcgggagcccctggaccatcacagacactttgggtaactcttacagtggaggataagtctgtccctttcttaatcaatacagaggctacccactccacattaacctttttttcaagggcctgtttcccttgcctccgtaactgttgtgggtattggcggccaggcttctaaacctcttaaattccccaactctggtgccaacttggacaacattcttttatgcacccctttttagttatccccacctgcccagatcccttactagattgagacattttaactaaattatctgcttccctgactattcctagcctacaaccacacctcattgccacccttttctccagttcaaagccgccttcacaccctccccttggatctccccaccttaatccacaagtataggacacctctactcccaccttggcaaccaatcatgcaccccttaccatcccattaaaacctaatcactcttaccccactcaatgccaatatcccatcccacagcacactttaaaaggattaaagcctgttatcactcgcctgttatagcatggccttttaaaacccataaacactccttataattcccccattttacctgttccaaaaactggacaagccttacaggttaatttcagaatctgcaccttatcaaccaaattgtcttgcctatccaccctgtggcgccaaagccatatactcttctatcctcaatacctccctccagaacccctctacatatattattatgtagatatgtacatatctacatatgtacataatctacataacccattctgttctggatctcaaacatgctttctttactattcctttgcacccttcatcccagcctctcttcattttcacttggactgacccggacacccatcaggctcagcaaattacctgggctgtactgccacaaggcttcacggacagccccccccccccccgttacttcagtcaagcccaaatttcttcctcatcctttacctatctcgacttaattcttcatgaaaacacagtgctctccctgctgatcgtgtctagctaatctcccaaaccccgaccccttctacaaagcaacagctcctttccttcctaggcatggttagatactccgcctttggatacctagctttaccatcctgactaaaccatcatataaactcacaaaagcaaacccagctgaccccacagatcctaaatcctttcgccactcctctttccgttccctgaaaacagccctagaagctgctcccacactagctctccctaactcatcccaacactttttcattacatacagccaaagtgcagggttgtgcagtcagaattcttacacaagagccaggaacggcccctgcagcccttctgtccaaacaacttgaccttactgttttaggctagcccccacattattcctgataccacacctgaccccccatgactgtatctctctaatccacctagcatttactcaatttccccatatttccttctttcctgttcctcaccctgatcacacttggtttattgatggcagttccaccaggcctaatcgccactcaccagcaaaggcaggctatgctatagtaacttccacacctatcattgaggctaccactctgcccccctccactacctctcagcaagccaaactcattgccttaactcaagccctcactcttgcagaaggagtacgtgtcaatatttatactgactctatgccttccatagagtcagcatgcaccaccatgctgttatatgggcagagagaggtttcctcactatgtaagggtcctccatcattaatgcctctttaataaaaattcttctcaaggtcgctttacttccaaaggaatctggagtcatttactgcaagagccatcaaaaggcatcagatcccatcattcagggcaacacttatgctgataagttagctaaagaagcagcttagttttccaacttctgtccctcacggccagtttttctccttctcatcggtcactcctacctactctcccactgaaacttccacctatcaatctcttcccacacaatgtaaatggttcttagacaaaggaaaatatctccttccagcctcacaggcccattctattctatcatcatttcacaacctcttccatgtaggttacaagccgctagcctgtctcttagaacctctcatttcctttccatcgtggaaatctatcctcaaggaaatcacttctcagtgttccatctgctattctactactcctcaaggattgttcaggccccctccctccctacacatcaagcgcggggatttgcccctgcccaggaccggcaaattgactttactcacaggccccgagtcaggaaactaaaatacctcttggtctggatagatgctttcactggatgcgtagaggcctttcccacagggtctgggaaggccaccgcagtcatttcttctcttctgtcagacataattcctcggtttggccttcccacctctatacagtctgataacggaccggcctttattagtcaaatcacccaagcagtttctcaggctcttggtattcagtggaaccttcatatcccttaccatctcaatcttcaggaaaggtagaagggactaatggtcttttacagacacacctcaccaagctcagcctccagcttaaaaaggactggacagtacttctacctcttgcccttctcagaattagagcctgtcctcaagaagctacacggtacagtccatttaaacttttatgtggacgcactttcttgctcagccccaacctcatcccagacaccagccctctaggcaactatcttccagtctttcagcaggctagacaggaaattcgccaggctgctaatcttctcttgcctactccagattcccagccacatgaagacaccctagctggatggtcagttcttgttaataatctgacccctcaaactctacaacctcgatggaccggaccctacttaaacatctatagtacccccaaccaccatctgcctgcagaaccctccccactgggttcaccgttccagaataaagctgtgtccgtcagacagccagtccgatatctcctcttcctcctggaagtcgcaagtactctcccctacttcccttaaactcactcgcatttctgaagaacaataacccttatgagcctaatacatcccttcattctattaggtctatccatccttaccctactcttcgcaacagggctttacgcagtcacccccactacttggactgtgccccaaaaacctgtcatccctactatcttctgtctagtcatactcctattcaccattctcaactactcataaatgacctgctcttgtttacactgccagtttacattgtttctccaagacatcacagctgatatctcctggtgatatccccaaaccgccactcttgactcctgcttggagtggatagatgatctttggtggcagggcaccctccaacacttccaccctgatgaagttctattctttacttttatattcactcttattctcattcccattcttatgccactctctacctctccccagttacctccagcatactatcaatctcacccactctctcctcactgcctccaatccttttctagcaaagaattgttggctacgcgtttccctttcctcctgcttttacacagccatccctgctctacaggctgactgggctacctctcccgtctccctgcaactcagaacctcctttaataaccctcatctttacccgcctgaggaacttctttattttctagacagatttggtgagaactccccagacatttcacaccaacgagctgccacacttctccgcatctacttacggcatctttctccttatgtcaattccactcctcccatatttggaccccaaccacacaaacaactatccctgttgccgtttctttatgcatctcccgacaacagcctgctggaatccctttaggcaaccttccaccgtccaaatgttcctttactctttgtctccagaacccagccacacacattaccaaacagatgggagcattccaacttcgcattactgacaagccctctatcattattgacaaactaaaaaacattggcagtcactattgtttaggaagacacctaccctgcatctcaccccatccttggctaccaccctcccctgctcgtctgaatctcctcctagcccctcctcttgcttgcttataccctgccccatgaatagcagcgaaaggttacttgtagacactatgcgctttctcatacaccatgaaaaccaaacccctccctctacgcagttgcaccatcaatccccattacaacctctaacggctgctgcccttgctggatcgctaggattctggatgcaggattcctctttcagtacaccctctcaccttttcactttacatttccagttctgcctgacacaaggtctcttctttttatgtggctcttccacctacatgtgcctacctgccaaatggatgggcacatgtactctagtcttccttacctccaaaatccagtttgcagatgggaacgaacaactgcctgtccccctcatgacatcaacacaacaaaaaagagtcatcccactaatccctttacttattggtctaggactttctgcctccagtattgcacttggaactggaatagcaggcatctcaacctctgtcacaacagtccgcagcctctctaatgacttctctgctagcactacagatagatcacaaactttatctgttctccaagcccaggttaactctttagctgcagttgtcctccagaacggccaaggccgcgatttactcactgctgaaaaaggaggactctgtatatttttaaatgaagagtgttgtttttacctaaatcaatctggcctgctatatgacaacataaaaaaactcaaggatagagcccaaaagctcgccaaccaagcaaacaataacattgaacccccttggacactctctaattggacgtcctgggtactcccaattcttagtcctttaatacctatttttctccttcttttattcggaccttgtgtctttcgtttagtttctcaattcatataaaaccgcatccaggccatcatcagtaattctatatgacaaatgctccttctaacaaccccaaaatctttcttcagttgaatctctcccactgtaggttcccacaccgcccctgatcccgctcgaagcagccttgagaaacatcgcccattatctctccataccacccccaaaatttgtcactgctccaacacttcaccactattttgttttgcttttcttattaatataagaagacaggaatgtcagccctctgagcccaagctaagccatcatatcccgtgacctgcatatacatccagatggcctgaagcaactgaagatccacaaaggaagtgaaaatagccttaactgatgacattccaccat

SEQ ID NO: 88 - DNA, 2132 bp, Homo sapiens
ttatagtgggtagctagtcaggcatgagcggggcaagagagggctccccacaacccccaccaaaaatgtcaggggctcatcaggtgatgttcaggcagtgctgtttctctaaaataattggttgcagccaatgccagggaaaggcagtctcccaacagacagaaaaaacctgaaactggtgatcagcagcttcatgataagatattaggagttgggcgactgggctcaagcatgcacattgaggcaaaatggtgtagttgaactggtatatgacctcctagggacatctgactggtaagggaagaattcctcaagtgagcatgcctacaactccagtaacacactgtgcatgctcccctcccaagcgctagcaggccaccatacatgcagacagcccaccccaagggaagaatcaggggagaacgaacgcaagaccctggaattatgcaaacatataaaaccctaagtcaaaaggtcaaaccacgcactgatatttcaagtcacccacttggccctcttccaagtggactttccttccctttgtaacttctctaaagcttttaaacaaactttcattcctgttccaaaacttgccttgatctctcctgccttccatctcctcagtcaaattcttccttctgaggaggcaagaactgaggttgctgtagacctgtatgaatttgccactgctaacatactttggtgctatatgactcggataagttccctagtagtacaagacctatacaccttgcctgcttcagctggaggcattcaacccgtctacatggtttcctcctcctttttgctctcttgcttactaaccaaccccacaaacaattcctctcagctacagtggctctactccccccagctgatctctcagcttaccctgatgggtagctcacgggagtgggaaggaccttggggtccacactgagtagaactaatggccctcctgggcaggaggctcatgaaagtggtagggctaaagtctaaaactgtgcaatgtctgggttttcctctgctttttcaactaaaatcagcttttccccaagaacctgcactgcctattcttctattttctctgtgtgttctgaaatggccttgaacacccagccagacagtctgccttgggggcaagtctggctctttgctttcacttcacatgccacatgacttcttaaacacacactccctgttattcatgtgtccgcggctcttgctgaattttcatggcagaaaagacacaggctcctttgcagatagcccctgagatttatacttgtttttatcctaccagctcagatgacctccaacccttcccctgtctgctggcacattgctgggacagacactaattggaactgtagctctgccagctccttataacttactatatgctttttgttcctgttacaccccagggccaagttttccagtggcttttgaagcaatttgtctgcctacataggacctcactctggccctttaaggatcccacctacttgcctacttgctttttttttttttttttttttttttttttttttttttttagtaagcacccactgggaggaggataaattcttcctttgccatttgcgagttcttaccccaagccccaagtcccctggagtttactcctttatgtcaagagggcaaataaatgttgcccccttgaatccaagggctgctgtttttgtgaggatatgaaggctttccatgagtattcctcttgcttcctcccacttcctcctgtagcttccatttctctaaccacttccatgcccttattaacatacatcaagaccttcaaggtcatatttgcagggagggaagtctagccccttggggcagttaactgaaaaacaggcttctcatctacttaaagaacatggaaatgggaatataagaaaatagataatcattttgttgctaaatgctgaagtgagagtcactatagggtcatggagacaaggatataggctggcccaaggcagcaggtgcaagagacccattggacagagatgaagtttagccctaggctaacagattaccattagaacagagatgaaggcaaggttaggggtacacagtaagaccagttcattccagaaccttagggacga

SEQ ID NO: 89 - DNA, 3389 bp, Homo sapiens
gtcaggcctctgagcccaagccaagccattgcatcccctgtgacctgtacatatatatccagatggcctgaagtaactgaagatccacaaaagaagtaaaaatagccttaactgatgacattccaccattgtgatttgtttccgccccaccctaactgatcaatgtactttgtaattctccccacccttgagaatgtactttgtgagatccacccctgcccgcaaaacattgttcttaacttcaccgcctatcccaaaacctataagaactaatgataatccaccaccctttgctgactctctttttggactcagcccacctgcacccaggtgaaataaacagccatgttgctcacacaaagcctgtttggtggtctcttcacacagacgcgcatgaaatttggtgccgtgactcagattgggggacctcccttgggagatcaatcccccgtcctcctgctctttgctccatgagaaagatccacctacgacctcaggtcctcagaccgaccagcccaagaaacatctcaccaatttcaaatccggtaagtggcctctttttactctcttctccaacctccctcactatccctcaacctctttctcctttcattcttggcgccacacttcaatctctcccttctcttgatttcaattcctttcattttctggtagagacaaaggagacacattttatctgtggacccaaaactccggcgctggtcacggactgggaaggcagccttcccttggtgtttaaccattgcagggacgcctctctgatcattcacccacgtttcagcggtgtcagaccacgcagggatgcctgccttggtccttcacccttagcagcaagtcccacttttctgggggaggggcaagtaccccagctccttctctccatgtctctaccccttctctgattttctggggcagaggcaagaaccccccaaccccttctccttcacccttagcagcaagtcctgcttttctgggggaggggcaagtaccccaaccttgtatctctgcaccccaatcccttatttccatgccccaacccctttcccgcttttctggagggtaagaacccccaaaccccttccctccatgtctctatgctcccttttctctgggcttgcctccttcactatgggcaaccttcctacattcctccttcttctcccttagcctgtgttctcaagaacttaaaacctcttcaactcacacctgacctaaaacctaaatgccttattttcttctgcaatgccgcttgacccaatacgaactcgacagtagttccaaatagccagaaaatggcactttgaatttttccatcctgcaagatctaaataattcttgtcataaaataggcaaacggtctgaggtgcctgacgtccaggcattcttttacacatcagtcccttcctagtctctgtgcccagtgcaactcgtcccaaatcttccttcccctcagtcccaaccccaagcgtcactgagtctttctaatcttccttttctacagacctatctgacctctcccctccttgccaggccgagctaggtcccaattcttcctcagcctccgctcctccaccctataatcctatcacctcccctcctcacaccaggtctggcttacagtttcgttctgtgggaggccccacctgcccagcaatttattcttaaaaaggtggctggagctaaaggcatagtcaaggttaacactcctttttctttatcccaaatcagatagcgtttaggctctttttcatcaaatataaaaatccagcccagttcatgacttgttcggcagcaaccctgagacactttacagccctagaccctaaaaggtcaaaaggccgtcttattctcaaaatacattttattacccaatctgctcccgacattaaataaaactccaaaaattaaattctgaccctcaaaccccacgacaggatttaattaacctcgccttcgaggtgtacaataatagaaaaaagttgcaattccttgcctccactgtgagacaaaccccagccacatctccagcacacaagaacttccaaaggcctgaactgcagcggccaggcgttcctccagaacctcctcccccaggagcttgctacaagtgccagaaatctgaccaccaggccaaggaatgcctgcagcccaggattcctcctaagccgtgtcccatctgtgcgggaccccactggaaatcggactgttcaactcacctggcagccactcccagagcccctggaactctggcccaaggctctctgactgactccttctcggcttagcggctgaagactgacgctgcccgatcgcctctgaagctccacagaccatcacggacaccgagctttgggtaactctcacagtggagggtaagtccatcccctgtttaatcgaaaccgggactatgcactccacgttgcctacttttcaagggcctgtttcccttgcctccataactgttgtgggtattgacggccaagcttctaaacccctgaaaactcccccactcttgtgccaacttggacaacactcttttatgcactgctttttagttatccccacctgcccagttcccttattaggccgagatattttaaccaaattatctgcttccctgactattcctggactacagctacatctcattgctgcccttctccccaacccaaagcctccttcgcgtcttcctctcatatcccccccaccttaacccacaagtatgggacatctctactccttccctggcaactgatcacatgcccgttaccatcccattaaaacctaatcacccttaccccgctcaacgccaatatcccatcccacagcacgctttaaaaggattaaagcctgttatcactcgcctgctacagcatgggcttctaaaacctataaactctccttacaattcccccattttacctgtccaaaaactggacaagtcttacagattagttcagaatctgcgccttatcaacaaaattgtttcacctatccatcctgtggtgcccaacccgtacactcttttgtcctcaataccttcctccacaactcactattccgttctcgatcttaaagatgcttttttcactattcccctgcacccctcgtcccagcctctctttgctttcacttagactgaccctgacacccattaggctcagcaaattacctgggctgtactgctgcaaggcttcatagacagcccccattacttcagtcaagcccaaatttcatcctcatctgttacctatctcggcataattatcataaaaacacgtgctctccctgctgatcgtgtccgattaatctcccaaacctcaatcccttacaaaacaacagctcctttccttcctagccatggttag

SEQ ID NO: 90 - DNA, 695 bp, Homo sapiens
ttacagtagatagcgagtcaggcatgagcggggcaggagagcctctgcctccctaggaatatcaggcaaccatcaggtgatggccaagcagttattacactgcttctctaaaataataattggtcactgctagtgcgagggaaaggcagtctcccagtagaaaaacctgaaactgatggtcaataggttcctgataagatctcaggagttgggcgagtgggctcaagcatgcacattaagaggtaaagtgacggagttgaactgttcctcgtaggaacattcagctggtaagggaagaacgcctcaagtgagtatgcatacaactccagtaaacacactgtgcatagggcccctcccaagtgctagcaggccactgtgcatgcagacagcccaccccaaggcaagaatcaggggagaaaggaaacaagaccccagaagtatgccaacatataaaaccccaagtcagaggtcaaactgtgcacttgatctcccaagccacctgcttggccctcttccaagtgtacttagcttcctttcatccctgccctaaaacgttttaataaactttcactcctgctctaaaacttgccttggtctgtcactctgccttatgacccctcggttgaattctttcttctgaggaggcaagaattggggctgatgcagacctgtatggattcaccaccgctaacata

SEQ ID NO: 91 - DNA, 7330 bp, Homo sapiens
ctttgggtcccctcccttcgtatgagagctctgttttcactctattaaatcttgcaactgcactgttctggtccgtgtttgttacagctcaagctgagcttttgctcgccgtctaccactgctgtttgccgccatcgcagactcgctgctgacttccatctctccagatccggtaaggtgtctgctgtgctcctgatccagtgaggcacccattgctgctcccgattgggctaaaggcttgccattgttcctgcatggctaagtgcccgggttcatcctaatcgagctgaacactagtcactgggttccatggttctcttccataacccatggcttctaatagagctataacaatcaccgcatggcccaagattccattccttggaatccgtgaggccaagaaccccagatcagagaacatgaggcttgccaccatcttggaagcagcccgccgccatcttgggagctctgggagcaaggaccccaggtaacatttggtgaccacgaagggacttccaaagcggtgagtaatattagaccactttcacttgctattctgtcctattcttccttagaattggaggaaaatactgggcacctgtcgtccggttcgtctgtctggagccagcttccactttcaattttcttggagaaaccaagggccgactagaggcagaaagctgtcatcccgaactcctgacattagccggttgagatcatggcacagccagaagtctctacagtcgcccatgcgtgtgcccctacctttccctctgacccatacctcctgggtcccgaccacgactttcttgaaagtgtagccccaaaattctccttacctctgaatctgcttcctctgatccctgcctcctaggtactaatggttcagactttcatttcctctagcaagctgtatctcgaaagggatctaaggaagctctacgctgtgtcctgaggcatctagacataaacccagggagtcttatccctggtgtccctcctgatttaggtatacagctctcgatatgggcagttatgtgggacccgttccccaccacccttgccagggccccaagtttgtaatggctaagagaagagaaagagtgacagaggagagagagatggaagagagaaagagagatggaagagagagagagagagagagatggaggagagacagaggagagagagacagaggagagacagaggagatagagagagagagataaagagggagtcaaagagaaaaagaaaaagacagaaatagtaaacaaacaaacaaacaaaaaccagtgtgccctattcctttaaaagccagggtaaatttaaaacctatgattgataattgaaggtcttctccctgaccctataacattccaataccactttgttgtcagtgtaaataagggcgtagccgaaagcactgaggccaccgacaaccagtagccttcctatcaaaaatccttaacccaggaacccgcgggtggcccaaatgcattcaatctgtagcagcaactgctttgctaacagaagaaagtagaaaattagcctttagaggaaacctcattgtgagcacacctcaccagttcagaactatcgtaagtcaaaaaagcaaacaggtagcttactaactcaaaaatcttaaagtatgggtctattctgttagaaaaaggtaatttaacaccaaccactgataattcccttaacccagcagatttcctaacaggggatttaaatcttaattaccatacaaaggtccgaccagacctaggaggaactcccttcaggacaggacacagggtctcgctctgtcacccaggctggagtgcagtggtacaattatggcgctcactgcaacttcaactttccaggcccaagcaatccacccccctcacccccacaattagttgagggtacaggtgtgtgccaccatacctggttaatttttctttactttttgtatagacaggatctcactgtgttgcccaggctggtcgcaaactcctgggctcaagcgatcctcctgtcttggcctcccaaagtgctaggattacagatgtgagccaccacacctggccctgaccgatagatggttcctcccaggagactgagggaaaaaccacaacgggtattcagtaattgatagggagactcttgtggaagcagagttagaaaaattgcctaataattggtctcctcaaacgtgggagctgtttgcacttagccgagccttaaagtacttacagaatcaaaaaagactatctcaatcctgactcaaaaggttacccacaccctctctgaaacaaatttgcataagaactgttgtttatgggaatgaatcttgatggggcagctgggttgttatgaaatactcaggaacccagcccagctctaggactcacccctgagcacaaatgcaatgttgggcacgctggtaaaggaccactagaatccagcagcccggacccatttctttgtggtcaagaaagacggaaaaaggggtgcaggactgctacatcggtaagcgtaactaatccgataagcagaggtccatgggtggttacgcaccctggaagggaataaacattaggaccatagaggacgctctaggactaatgctcatcagaaaatgactaggggtgctggcatccctatgttcttttttcagatgggaaacattccccccaaggcaaaaacgcccctaagatgtattctggagaattgggaccaatttgaccctcagatgctaagaaagaaactacttatattcttctgcagtactgcctggccacaatatcctcttcaagggggagaaacctggcctcctaagagaagtataaattataacagcatcttacagctagacctcttttgtagaaaagaaggcaaatggagtgaagtgccatatgtgcaaactttcttttcattaagagacaactggcaattatgtaaaaagtgtgatttatgccctacaggaagccctcagagtctacctccctaccccagtgtccccctgactccttccccaactaataaggaccccccttcaacccaaatggtccaagaggagatagacaaaggggtaaacaatgaaccaaagagtaccagtattccccgattatgccccctccaagcagtaggaggaggagaattcggcccagccagagtgcatgtacctttatctctctcagacttaaagcaaattaaaatagacctaggtaaattctcagataaccctgatggctatattgatgttttagaagggttaggacaatcctttgatttgacatggagagatatgttactgctaaatcagacactaaccccaaatgagagaagtgccgccataactgcagcccgagagtttggtgatctctggtatctcagtcagctcaatgataggatgacaacagaggaaagagaatgattccccacaggccagcaggcagttcccactgtagaccttcattgggacacagaatcagaacatggagattggtgccgcagacatttgctaacttgcgcgctagaaggactaaggaaaactaggaagaagcctatgaattattcaatgatgtccactataacacagggaaaggaagaaaatccttctgcctttctggagagactaagggagacattgaggaagcatacctccctgtcacctgactctattgaaggtcaactaatcttaaaggataaatttttcactcagtcagctgcagacattagaaaaaaacttcagaagtcctccttaggcctggagcaaaacttagaaaccctattgaacttggcaacgttggttttttataatagagatcaggaggaacgggacaaacgggataaaaaaaaaagggccaccgctttagtcatggccctcaggcaagcggactttggaggctctggaaaagagaaaagctgggcaaatcgaatgctaatagggcttgcttccagtgcggtctacaaggacactttaaaaaagattgtccaagtagaagtaagccaccccctcgtccatgccccttatgtcaagggaatcactggaaggcccactgccccaggggacgaaggtcctctgagtcagaagccactaaccagatgatccagcagcaggactgagggtgcccggggcaagtgccagcccatgccatcaccctcacagagccccaggtatgctagaccattgagggccaggaggttaactgcctcctggacactggcacagccttctcagtcttactctcctgtcccggacaactgtcctccagatctgtcactatccgaggggtcctaggacagccagttactagatacttctctcagccactaagttgtgactggggagctttactgttttcacatgcttttctaattatgcctgaaagccccactcccttgttagggagagacattctagcaaaagcaggggccattatacacctgaacataggagaaggaacactcgtttgttgtcccctgcttgaggaaggaattaatcctgaagtctgggcaagagaaggacaatatggacgagcaaagaatgcccgtcctgctcaagttaaactaaaggagcccgcctcctttccctaccaaaggcagtacccccttagacccgaggcccaacaaggactccaaaagattgttaaagacctaaaagcccaaggcctagtaaaaccatgcaatagcccctgcaatgctccaattttaggagtacagaaacccaacggacagtggaggttagtgcaagatctcaggattatcaatgaggccgttgtccctctatacccagctgtacctaacccttatactctgctttcccaaatgccagaggaagcagagtagtttacagtcctggacctaaagggtgccttttgtgcatccctgtacatcctgactctcaattcttgttttcctttgaagatccttcgaacccaacgtctcaactcacctggactgttttaccccaagggttcagggatagcccccatctatttggccaggcattagcccaagacttgagccagttctcatacctggaccctcttgtcctttggtacgtggtgatttaattttagccactcgttcagaaaccttttgccactaagccacccaagcactcttaaatttcctcgccatctgtggctacaaagtttccaaaccaaaggctcagctctgctcacaacaggttaaatacttagggttaaaattatccaaaggcaccagggccctcagtgagaaacgtatccagcctatactggcttatcctcatcccaaaacactaaagcaactaagaggattccttggcataacaggcttctgccaaatgtggtttcccaggtacggcgaaatagccaggcctttatatacactaattaaggaaactcagaaagccaatacccatttagtaagatggacacttgaagcagaagcagctttccaggccctaaagaaggccctaacccaagccccagtgttgagcttgccaacaaggcaagacttttctttatatgtcacagaaaaaaccggaatagctctaggagtccttacacaggtccgagggatcagcttgtaatctgtggcgtacctgagtaaggaaattgatgtagtggcaaagggttggcctcattgtttactggtagtggcagcagtaacagtcttagtatctgaagcagttaaaatgatacaggaagagatcttactgtgtggacatctcatgatgtgaatggcatactcactgctaaaggagacttgtggctgtcagaaaaccgtttacttaaatatcaggctctattacttgaagggccagtgctgcgactgtgcacttgcgcaactcttaatccagtcacatttcttccagacaatgaagaaaaaaatagaacttaactgtcagcaagtaattgctcaaacctgcgccgctcgaggggaccttctagaggttcccttgactgatccccacctcaacttgtatactgatggaagtccctttgtagaaaaaggacttcgaaaagcagggtatgcagtggtcagtggtaatggaatacttgaaagtaattccctcactccaggaactagcgctcagctggcagaactaatagccctcacttgggcactaaaattaagggaagaaaaaaggtaaatatatatacagactcttaagtatgcttacctagtcctccatgcccatgcagcaatatagagagaaagggaattcccaacttccgagggatcacctatcaaacatcaggaagccattaggagattattattggctataaagaaacctaaagaggtggcagtcttacactgccaaggtcatcagaaaggaaaggaaagggaaacagaagggaatcgccaagcagatattgaagccaaaagagccgcaaggcaggaccctccattagaaatgcttatagaaggacccctagtgtggggtaatcccctccaggaaaccaagccccggtactcagaagaagaaatagaatggggaacctcatgaggacatagtttcctcccctcaggatggctagccaccaagaaggaaaaatacttttgcctgcagctaaccaatggaaattacttaaaacccttcaccaaacctttcacttaggcattgatagcacccatcagatggccaaatcattatttactggaccaggccttttcaaaactatcaagcagatagtcagggcctgtgaagtgtggcaaagaaataatctcctgcactgcaggccatatatttcaatccctctatctttaacctccttgttaagtttgtctcttccagaatcgaagctgtaaaactacaaatcattcttcaaatggagccccagatgcaatccatgactaagatctactgcggacccctggaccggcctgctagcccatgctccaatgttaatgacattgaaggcacccctcctgaggaaatctcaactgtacaacccctactatgccccagttcagcaggaagcagttagagtggttgttggccaacctccccaacagcacttgggttttcctgttgagaggggggactgagagacaggactagctgaatttcctaggccaactaagaatccctaaggctagctgggaaggtgaccacgtccacctttaaacacggggcttgcaacttagctcacatctgaccaatcagagagctcagtaaaatgctaattaggcaaaaacaggacgtaaagaaatagccaatcatcttatcacctgagagcacaatgggaaggacaatgatcgggatgtaaacccaagcattcgagccagcaacagctaccctctttgggtcccctccctttgtatgggagctctgtcttca

SEQ ID NO: 92 - DNA, 5300 bp, Homo sapiens
gtcagggcctctgagcccaagccaagccactgcatcccctgtgacttgcacatataccgcccagatggcctgaagtaactgaagaatcacaaaagaagtgaaaatgccctgccccaccttaactgatgacattccaccaaaaaagaagtgtaaatggccggtccttgacttaagtgatgacattaccttgtgaaagtcctttttctggctcatcctggctcaaaaactcccccactgagcaccttgctacccccactcctgcccgccagagaacaaaccccctctgactgtaattttcctttacctgcccaaatcttataaaatggccccacccctatctccctttgctgactctcttttcggactcagcccgcctgcacccaggtgaaataaacagccatgttgctcacacaaagcctgtttggtggtctcttcacatggacgcgcatgaaatttggtgccatgactcgggtcagggaacctcccttgggagatcaatcccctgtcctcctgctctttgctccgtgagaaagatccacctacgacctcaagtcctcagaccgaccagcccaagaaacgtctcaccaatttcaaatccggtaagtggcctctttttactctcttctccaacttccctcactacccctcaaccccttctccttcacccttagcggcaagtcccgcttttctaggggacaagaacccccaatcccttatttccacgccccgacccctttcccgcttttctggagggtaagaacacttgaaccccttccctccatgtctctatgctctcttttctctgggcttgcctccttcactatgggcaaccttccaccctccattcctccttcttgtcccttagcctgtgttcttaagaacttaaaacctcttcaactctcacctgacctaaaatctaagcgtcttattttcttctgcaatgccgcttgaccccaatacaaactcgacagtagttccaaatagccggaaaacagcactttcaatttttccatcctgcaagatctaaataattcttgtcataaaatagacaaatggtctgaggtgcctgacgtccaggcattcttttacacatcagtcccttcctagtctctgtgcccaatgcaactcatcccaaatcttccttctttacctcctgcctgtcccctcagtcccaaccccaagcatcactgagtctttctaatcttccttttctacagacccgtctgacctctcccctcctcgccaggctgagctaggtcccaattcttcctcagcctctgctcctccaccctataatccttttatcacctcccatcctcacaactggtccggcttacagttacgtttcgtgactagccctcccccacctgcccagcaatttactcttaaaaaggtggctggagctaaaggcatagtcaaggttaatgctacttttctttatcagacctctcccaaatcactgagcatttaggctttttcatcaaatatgaaaaacccagcccagttcatggctcgttcggcagcaaccctgagacgctttacagccctagaccctaaaaggtcaaaaggccatcttattctcaatatacattttattacccaatctgctcccaacattaaataaaactccaaaaattagaatctggccctcaaaccccacaacaggacttaattaacctcaccttcaaggtgtacaataatagaaaaaagttgcaattccttgcctccactgtgagacaaaccccagccacatctccagcacacaagaatttccaaacgcctgaaccgcactggccaggcgttcctccagaacctcctcccccaggagcttgctacaagtgccagaaatctggccaccaggccaaggaatgccctcagcccaggattcctcctaagccgcgtcccatctgtgtaggaccccactggaaatcggactgttcaactcacctggcagccactcccagagcccctggaactctggcccaaggctctctgactccttctcggcttagcggctgaagactgatgctgcccgatcacctcagaagccctgtagaccatcacggatgccaagctttaggtaactctcacagtggaaggtaagcccatccccttcttaatcaatatggaggctacccactccacattaccttcttttcaagggtctctttcccttgcctccataactgttgtgcgtattgacagccaggcttctaaacctcttaaaactccccaactctcgtgccaacttagacaacactcttttaagcactcctttttaattatccccacctgcccagttcccttattaggctgagacactttaactaaattatctgcttccctgactgttcctggactacagctgcatctcattgccacccttctccccaacccaaagcctcctttgtgtcctcttttatccccccgaccttaacccacaagtataagacacctctactccctccttggtgacccatcatgcaccccttaccatctcattaaaacctaatcaccctcaccctgctcaaagccaagatcccatcccacagcacgctttaaaaggattaaagcctgttatcactcgcctgctacggcatggccttttaaagcctataaactctccttacaattcccccattttacctgtcctaaaaccagacaaggcttacaagttagttcagaatctgtgccttatcaaccaaattgttttgtctatccacctcgtggtgccaaacccatatactctcctatcctcaatacctccctctactacccattattctgttctggatctcaaacatgctttctttactattcctttgcacccttcatcccagcctctctttgctttcacttagactaccctgacacccatcaagctcagcaaattacctgggctgtactgccacaaggcttcacagacagcccccattacttcagtgaggcccaaatttcatcctcatctgttacctatctcggcataattctcataaaaacacacatgctttccctgctgatcgtgtccaattaatctcccaaacctcaatcccttacaaaacaacaactcctttccttcctaggcatggttagtgcagtcagaattcttacacaagagccaggaccacaccctgtaacctttctgtccaaacaacttgaccttactgttttagcctagccctcatgtctgcgtgcagtggctgccactgctttaatacttttaaaggccctaaaaatcacaaactatactcaactcactctccacatttctcataacttccaaaatctattttcttcctcatacctgacgcatatactttctgctccccagctccttcagctgtactcactctttgttaagtcccacaattaacattgttcttggcccggacctcaatctggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcattgcctttccatcatggaaatctatcctcaaggaaataacttctcagtgttccatctgctattctactactcctcagggattattcaggccccctcccttccctacacatcaagcttgaagatttgcccccatccaggactggcaaattagctttactcaacatgccccgagtcagataactaaaatacctcttagtctaagtagacactttcactagataagtagaggcctttcctacagggtctgagaaggccaccacagtcatttcttcccttctgtcagacataattcctcattttagccttcccacctctatacagtctgataacagaccagcctttattagtcaaatcagccaagcagtttttcaggctcttagtattcagtgaaacctttatatcccttacagtcctcagtcttcaggaaaagtagaacagactaatggtcttttaaaaacacacctcaccaagctcagccaccagcttaaaaaggactggacaatactttaaccactttcgcttctcagaattcaggcctgtcctcggaatgctacaaggtacagcccagttaagctcctgtatagacgctcctttttattaggccccagtctcattccagacaccagaccaacttagactgtgccccaaaaaacttgtcatccctactatcttctgtctagtcatactcctattcaccgttctcaactactcatacatgccctgctcttgtttacactgccagtttacactgtttctccaagccatcacagctgatatctcctggtgctatccccaaaccgccactctaaactcttgaggtaaataaataatctttgctggcaggactatgctgaacctccttaggcactctccaatcagatgtcctgggtcctcccaattcttagaccttttatacctgtttttctctttctcttattccatttagtttttcaattcatataaaaccgtatccaggccatcaccaatcattctacacaacaaatgtttcttctaacaaccccacaatatcaccccttaccacaaaatcttccttcagcttaatctctcccaccccaggttcccacgccgcccctaatcccgctcaaagcagccctgagaaacatcgcccattctctctctccataccaccccccaaaaatttttaccgccccaatacttcaacactattttgttttatttttcttattaatataagaaggcaggaatgtcaggcctctgagcccaagccaagccattgcatcccctgtgacttgcatgtatacgcccagatggcctgaagtaactgaagaatcacaaaagaagtgaaaatgccctgccccaccttaaatgatgacattccaccacaaaagaagtgaaaatggccggtccttgccttaagtgatgacattaccttgtgaaagtccttttcctggctcatcctggctcaaaaagctcccccactgagcaccctgcgacccccactcctgcccgccagaggacaaaccccctttgactgtaattttcctttacctgcccaaatcttataaaacggccccaccccatctcccttcgctcactctcttttcggactcagcccgcctgcacccaggtgaaacaaacagccatgttgctcacacaaatcctgtttggtggtctcttcacacggacgtacatgaaa

SEQ ID NO: 93 - DNA, 5242 bp, Homo sapiens
gtcaggcctctgagcccaagccaagccatcgcatcacctgagacttgcaggtatacatccagatggcctgaagtaactgaagatccacaaaagaagtaaaaatagccttaactgatgacattccaccattgtgatttcttcctgccccacctaactgatcaatgtactttgtaatctcccccacccttaagaaggttctttgtaattctccccacccttgagaatgtactgtgtgagatccacccctgcccgcaaaacattgttcttaacttcaccgcctatcccaaaacctctcagaactaatgataatccaccaccctttgctgactctcttttcggactcagcctgcctgcagccaggtgaaataaacagccatgttgctcacacaaagcctgtttggtggtctcttcacacggacgcgcatgaaatttggtgccgtgactcggatcgggggaccgacctcccttgggagatcaatcccccatcctcctgctctttgctctgtgagaaagatccacctacgacctcaggtcctcagacagaccagcccaagaaacaactcaccaatttcaaatccggtaagcggcctctttttactcttttccaacctccctcactatctctcaacctctttctcctttcaatcttggcgccacacttcaatctctcccttctcttaatttctattccttttgttttctggtagagacaaaggagacacgttttatctgtggacccaaaactctggcgccggtcacggactgggaaggcagccttcccttggtgtttaatcattgcaaggacgcctctctgattattcacccacgtttcaaaggtgtcagaccacgcagggacgcctgccttggtccttcatccttggtggcaagtcccgcttttctgggggaggggcaagttccccaaccccttctctgtgtctctaccccttctctgcttttctggggaagggacaagtacccatcaaccccttctccttcacccttagtggcaagtcccgcttttctaggggtcaagaacccccaatcccttatttccgcaccccaacctcttatctctgtgccccaatcccttatttccatgccccgaccccgcttcctgcttttctggagggtaagaaccctgaaccccttccctccgtgtctctacgctctcttttctctgggtttgcctcctttactatgggcaaacttccaccctccattcctccttctcccttagcctgtcttctcaagaacttaaaacctcttcaactcacacctgacctaaaacctaaacgccttattttcttctgcaatgctgcttgaccccaatacaaactcgatagtagttccaaatagccagaaaatggcactttgaatttttccatcctgcaagatctaaataattcttgtcataaaataggcaaatggtctgaggtgcctgacgtccaggcattcttttacacatcacagtcccttcctagtctctgtgcccaatgcaactcgtcccaaatcttccttctttccctcccacctgtcccctcagtcccaaccccaagcgttgctgagtgtttctaatcttccttttctacagacccaactgacctctcccctcctcgccaggccaagctaggtcccaattcttcctcagcctccgctcctccaccctataatcgtttcatcacctcccctcctcacacccggtatggtttacagtttcgttccgtgactagcccttccccacctgcgcagcaatttattcttaaaaaggtggctggagctaaaggcatagtcaaggttaatgctcctttttctttatcccaaatcagatggcgtttaggctctttttcttcaaatataaaaatccagcccagtacatggctcgtttgacagcaaccctgagacgctttatagccctagaccctaaaaggtcaaaaggccgtcttattctcaatatacattttattacccaatctgctcctgacattaaataaaactccaaaaattggaatctggctctcaaaccccacaacaggacttaattaacctcgccttcaaggtgtacaataacagaaaaaaagttgcaattccttgcctccactgtgagacaaaccccagccacatctccagcacgcaagaacttccaaacgcccgaaccgcagcagccaggcgttcctccagaacctcctcccccaggaacttgctacacatgctggaaatcttggccactgggccaaggaatgcccgcagcctgggattcctcctaggccgcgtcccatctgtgtgggaccccactgaaaatcggactgttcaactcacctggcagccactcccagagcccctggaactctggcccaaggctctccgactgactccttctcggcttggcggctgaagactgacgctgcccgatcacctcgaaagccccgtagaccatcacagacgccgagcttcgagtaactatcacagtggaagataagtccgtccccttaatcaatacagaggctacccactccacattaccttcttttcaagggcctgtttcccttgcttccataactgttgtgggtattgacagccaggcttctaaacctcttaaaactccccaactctggtgccaacttagacgatactctttaaagcactccttttagttatctccacctgcccagttcccttattaggccgagacactttaactaaatcatctgcttccctgactattcctggattacagctacatctcattgctgcccttcttcccaatccaaagcctcctttgcgtcctcctcttgtattcccccaccttaacccacaagtataagatacctctactccttccttggcaaccgatcatgcaccccttaccatctcattaaaacctaatcacccttaccctgctcaatgggtaaggccttttaagcctataaactctccttacaattcccccattttacctgtcctaaaaccagacaagccttacaagttagttcaggatctgtgccttatcaaccaaattgttttgcctatccaccccatggtgccaaacccatatactctcctatcctcaatacctccctccacaacccattattctgttctggatctcaaacatgctttctttactattcctttgcacccgtcatcccagcctctcttcgctttcacttggactgaccctgacacccattaggctcagcaaattacctgggctgtactgccgcaaggcttcacagacagcccccattacttcagtcaagcccaaatttcatcctcatctgttacctatctcagcataattcttcataaaaacacacgtgctctccctgctgatcgtgtccaattaatctcccaaacctcaatcccttacaaaacaactcctttccttcctaggcatggttagtgtggtcagaattcttacacaagagccaggaccgcaccctgtagcctttctgtccaaacaacttgaccttactgttttagcctagccctcatgtctgcatgcagcggctgccgctgctttaatacttttagagccctaaaaatcacaaactatgctcaactcactctctacatttctcataacttccaaaatctattttcttcctcatacctgacgcatgtactttctgctccccggctccttcagctgcactcactcttaagtcccacaattaccattgttcctggcccggacttcaatctggcctcccacattattcctgataccacacctgacccccatgactgtatctctctgatccacctgatattcaccccatttccccatatttccttctttcctgttcctcactctgatcacgcttgatttattgatggcagttccaccaggcctaatcgccacacaccagcaaaggcaggctatgctatagtacaagccatgagcccgcctcttagaacctctcatttcctttccatcgtggaaatctgtcctcaaggaaatcacttctcagtgttccatctgctgttctactactcctcagggattattcaggccccctcccttccctacacatcaagctcagggatttgcccccacccaggactggcaaattagctttactcaacatgccccgagtcaggaaaccaaaatacctcttagtctaggcagacactttcactggataggtacaggccttttctacaaggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctctgtcttcaagaaaagtagaacggactaaaggtcttttaaaaacacacctcaccaagctcagccaccaacttaaaaaggactggacaatacttttacctcttttgcttctcagaatgctgcagggtacagcctatttgagctcctgtatggacaatcctttttattaggccccagtctcattccagacaccggaccaacttagactgtgccccaaaaaaacttgtcatccctactattttctgtctagtcatactcctattctccgttctcaactactcatacgtgccctgctcttgtttacactgctggtttacactgtttctccaagccatcacagctgatatctcctcatgctatccccaaactgccactcttaactcctgaagtaaacaaataatctttgctggcaggactatgctgaatctccttaggcactctctaatcagatgtcctaggtcctcccaattcttagaccttttatacctgtttttctccttctcttattccatttagtttttcaattcatacaaaactgtacccaggccatcaccaatacttctacacaacaaatgtttcttctaacaaccccacaatatcaccccttaccacaaaatcttccttcagcttaatctctcccactttaggttcgcacgccgcccctaatcctgcttgaagcagccccgagaaacatcgcccattctctctccataccaccccccaagacttcaacactattttgttttatttttcttattaataaaagaaggcagaaatgtcaggcctctgagcccaagccaagccatcgcatcacctgtgacttgcacgtatacatccagatggcctgaagtaactgaagatccacaaaagaagtaaaaatagccttaactgatgacattccaccat

SEQ ID NO: 94 - DNA, 295 bp, Homo sapiens
tgggtcaggcacaaagtaagcccaccacactaggaaatatgtggaaaaatttcaagaaaagatttaagggagactatggagtactatgacaccaggaaaacttaaaactttgtgtaaggtagactggccagcattagaggtggccatcagaaggaagcctggacaggtcccttgtttcaaaggtatggcacaaggtaacttgtaagccagggcacccagaccagttcccatacatagacacttggttacagctggttttagaccaccccccacagtggttgagagaacagcagca

SEQ ID NO: 95 - DNA, 1441 bp, Homo sapiens
acaatagtccagcttttattagtcaaatcacccaagccgtctctcaggctctcggtattcagtggaaccttcataccccttaccgtcttcaatcttcaggaaaggtagaatggactaatgatcttttaaagacacacctcaccaagctcagcctccaacttaaagaggactggacagtacttttacttcttgcccttctcagaattagcgcctgtccttgagatgctacagggtacagcccttttgaacttttatatggatgtgctttcttgcttggccccaaccttgttccagacaccagccctctgggcaactatcttccagtcctccagcaggctagacagaaaattcaccaggctgctaatcttctcacaaccttccgtagcttctctaataacttctctgctagcatcgcagacatatcacaaactttattaatccttcaggcccaggttgactctttagctgcggttgtcctccaaaaccgccaaggccttgacttactcactgctaaaaaaggaggactctgtatatttttaaatgaagagtgttgtttttacctaaatcaatctggcctagtatatgacaacataaaaaaactcaaggatagagcccaaaaacttgccatccaagtaaataattatgctgaacccccttgggcactctctaattggatgtcctgggtcctcccaattcttagccctttaatacctgtttttctccttctcttatttgtaccttgtgtcttctgtttagtttctcaattcatacaaaaccacacccaggccatcaccaatcattctatacaacaaatgctccttccaacaaccccacaatatcaccccttaccccaaaatctttcttcagtttaatctctcccactctaattacccatgccaccacaatcctgctcaaagcagccctgagaaacatcgcccattatctctccataccacagccaaaattttttgctgccccaacacttctccactattttgttttgtttttccactattttgttttgttttgttttgttttgtcaggcctctgagcccaggctaagccatcatatcccctgtgacctgcaggtatacatctagatggcctgaagcaactgacgaaccacaaaagaagtgaaaataggcagttcctgccttaactgatgactttccaccattgtgatttgttcctgccccgccccaaccaatcaatcgaccttgtgacattcctcccctggacaatgagtctcatgatctcccctctgagcaccttgtgacccctgcacctgcctgcaagagaaaaccccctttaactgtaattttccactgcctacccaaatcctataaaactgccccaccccatctccctttgctgactcctttttcggactcagtctgcctcgcctgcacccaggtgattaaaaagctttattgctcacaca

SEQ ID NO: 96 - DNA, 1939 bp, Homo sapiens
tgggtcaggcgcaaagtaagcccaccccactgggaactatgttaaaaaaaaatttcaagatttaagggagattacggtgttactatgacaccagaaaaacttagaactttgtgtgaaatagactggctagcattagaggtgggttggctatcagaagaaagcctggagaggtcccttgtttcaaaggtatggcacaaggtaacctgtaagccaaagcacccggaccagtttctatacatagacagttacagctggttttagacccccttccccctctccccacagtagttaagagaacagcagcataagcagctggcagaggcaaggaaagaccagcagagagaaaaaaaggccatctataccaattttaagttaatttagactgaacaaggtcttattaatagcaaaggataattgaaatcacaaacttataaggttttcaacaaaagtgaagtttgctaaaagttaacagtgtaacatgtattatggtaacttctaatcttgtggccttagacagtctagtcaaaacacataaagaaagtttgctttaaaaaaacaatggttatcttcaaaaataaaggggagaggcagaatttatataaaaagagttatatgataaattcttgtcctgaaataaattaactggttgtttaaagaaaagaatgtttgtaataagtcaaaaagttaaaacatgtttaaaaaattgtctgcaaaagtcataaaagaaaaaattttattaaaaaaattttaagcaaaaaatgttgtataatttaaaagtaataaggcctcctgtgtactattaagacagatgcaaattcctggttgaaatggatcaaatattccatctgcacattaaacaaaagcaattgttatgcttgtgcacatggcaggccagaggccctgattgtcccccttccactaaggtggtcctctagtcgaccaggcgtggactgcatggtagctcttttccaggattctacagcctggagtaataagtcatgccaagctctctctgctatatcccaaagtctctgcgggtcagcccccaagggccatgcagcttctgtctcccaacactaagttcacttcgtgtctctcacggcagagaggaaacttagtattccttggagacctgaagggatgcagtgagcttaagaattttcaagagcttatcaatcagtcagcccttgttcatccccgagtggatgtgtggtggtattgtggtggacctttactgggcactctgccaaataactagtgtggcacttgtgctttagtccatttggctatccctttcaccctggcatttcatcaaccaaaaaaaaaaagaaaaaagaaaaactcatgtcggccccagccctgaggctacctgacctgacaaaactctttacactctgtgtcagaaagagaaaaaatggcagttggagttttaacccagaatgtagggccctgaccaaggccagtggcctatctctcaaaacaactagacggggtttccaaaggctggcccccatgtccaagggtcctggcagcaagggccctgttagcacaagaagcaaataagctaactcttagacaaaacctaaacataaagtccccccatgctatggtgattttaataaataacaaaggaaaccattagctaatgaatgctagactaactagataccaaagcttgctctgtgaaaatccccgcataaccactgaagtttgcaacaccctaaaccctgccaccttgctccccgtatcagagagcccagttaaacataactgtgtagaagtactggactcagtttattctagtaggcccaaccactgagaccacgcttaaacatcagtagactaggagctgtacgtggataggagaagcttcgccaacccctgcaaagtgactctgaagaagatgacaagccctgctccagtcacacccggaagctga

SEQ ID NO: 97 - DNA, 5815 bp, Homo sapiens
gtcaggcctctcagcccaagctaagccatcatatcccctgtgacctgcatgtacacatccagatggccagttcctgccttaactgatgacattccaccacaaaagaaatgaaaatggcctgttcctgccttaactgatggcattatcttgtgaaattccttctcctggctcatcctggctcaaaagctcccctactaagcaccttgtgacccccactcctgcctgccagagaactacccccctttcctttacctacccaaatcctatagaatggctccaccccgtctcccttcgctgactctctttttggactcagcccacctgcacccaggtgaaataaacagccttgttgctcacacaaagcttgtttggtggtcttttcacatggatgtgagtgaaatttggtgccatgactcagatcgggcaagctcccttaggagatcaatcccctgtcctcctgctctttgctccgtgagagagagccacctatgacttctggtcctcagaccaagcagcccaagcaagatctcaccaattttaaatctggtaagcagcctctttttactctcttctccaacctccctcactatccctcaacctctatctcctttcaatcttggtgccacacttcaatctctcccttctcttaatttcaattcctttcattttctggtagagacaaaggaggcacattttatccgtggacccaaaactctggcgctggtcatggactagggaaggcagccttcccttggtgtttaatcattgcagggacacctctctgattattcacccaggtttcagaggtgtcagaccacgcagggacgcctgtcttggtccttcacccttagcggcaagtcctgcttttctgggggaggggcaagaacccttcaacaccttctctttcacccttagtggcaagtcccgcttttctggaggaggggcaggaatcccgacctaatatctctgcaccccgatcccttatttccatgccccaacctcttatctctgtgccccaaccccatatttccacgccctgaccccttctctgcttttctggagggcaagaaccccccaccccttctctgtgtctctactctcttttctctgggcttgcctccttcactatgcacaagcttccaccttccattcctccttcttctcccttagcctgtgttcttaagaacttaaaacctcttcaattctcacctgacctaaaatctaagcatcttattttcttttgcaatgccgcttgaccccaatacaaactcgacagtagttccaaatagccggaaaatggcactttcaatttttccatcctacaagatctaaataattcttgtcaaaaaatggccaaatggtctgaggtgcctgacatccaggcattcttttatacatcggtccctccctagtctctgttcccaatgcaactcgtcccaaatcttccttctttccctcccacctgtctcctcagtcccaaccccaagcatcactgagtctttctaatcttccttttctacagacccatctgacctctcccctcctccccaggctgctcctcaccaggctgagctaggtcccaattcttcctcagcctccactcctccaccctataatccttttatcacctcccctcctcacaccaggtctggcttacagtttcattccctgactggccctccccaacctgcccagcaatttactcttaaaaagttggctggagttaaaggcatagtcaaagttagtggtcctttttctttatcccaaatcagatagcatttaggctctttttcatcaaatataaaaatccagcccagttcatgactcgtttggcagcaaccctgagatgctttacagccctagaccctaaaaggtcaaaaggccgtcttattctcaatatacattttattacccaatctgctcccgatattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccagcacacaagaacttccaaacacctaaaccgcagtggccaggtgttcctccagaacctcctcccccaggagcttgctacaagtgccagaaatctggccaccaagccaaggaatgcctgcagcccgggattcctcctaagctgtgtcccatctgtgggggaccccagtggaaatcagactgttcaactcacctggcagccactcccagagcccctggaactctggcccaaggctctctgctgactccttcccagatcttcttggcttagcggctgaagactgacactgcccgattgcctcggaagccctgtagaccatcacggacgccgagctttaggtaactctcacggtggagggtaagtccgtccccttctgaatcaatacggaggctacctactccacattactttcttttcaagggcctgtttcccttgcctccataactgttgtgggtattgacagccaggctgctaaacctcctaaaactccccaaatctggtgtcaacttagacaatactcttttaagcactcctttttagttatccccacctgcccagtttccttattaggctgagacactttaactaaattatctgcttccctgactattcctggagtacagctacatctcattgccgcccttcttcccaatccaaagcctcctttgcttcctcctcttgcatccccccaccttaacccacaagtataagatatctctactccctccttggtgaccaatcatgcaccccttaccatctcattaaaacctaatcacccttgccctgcttaatgccaatatcgcatcccacagcatgctttgaaaggattaaagcctgttatcactcgcctgctacagcgtggccttttaaagcctataaactctccttacaattcccccattttacctgtcctaaaaccagacaagccttacaagttagttcaggatctatgccttatcaaccaaattgttttgcctatccaccccatggtgctaaacccatatactctcctatacttgataactccctccacaatccattattctgttctggatctgaaacatgctttctttactattcctttgcacccttcatcccagcctctctttgctttcacctggactgaccctgacacccatcaagctcagcaaattacctaggctttactgctgcaaagcttcacagatagcccccattacttcagtcaagcccaaatttcttcctcatctgttacctatctcagcataattctcagaaaaacacatgcactctccctgctgatcgtgtccagctaatctcccaaaccccaatcccttctacaaaacaacaactcctttccttcctgggcatggttggatactttcacgtttggatacctggttttgccatcctaacaaaaccattatataaactcacaaaaggaaacctagctgaccccatagatcctaaatcctttccccactcctctttccattccttgaagacagctttagaggctgcccccatcctagctctccctgactcatcccaacccttttcattacacacagccgaagggcagggctgtgaagtcggaattcttacacaaggaccgggatcacgtcctgtagcctttttgtccaaataacttgaccttactgttttaggctggccatcatgtctccatgcagcggctgctgccgccctaatacttttagaggcccttaaaatcacaaaatatgctcaactcactctctacagctctcataatttccgaaatctattttcttcctcacacctgacacgtatactttctgctccctggctccttcagctgtactcactctttgttgagtctcccacaattaccattgttcctggctcggacttcaatgtggcctctcacattattcctgataccacacttgaccctcatgactgcatctctctgatccacctgacgttcaccccatttccccacatttccttcttccctgtttctcaccctgatcacacctggtttattgatggcagttccaccaggcctaatcgccacatgccagcaaaggcaggctatgatatagtacaagccactagcctgcctcttagaacctctcatttcctttccatcatggaaatctatcctcaaggaaatcacttctcagtgttccatctgctattctgctacttctcagggattattcaggccccctcccttccctacacatcaagctcagggatttgcccccacccaggactggcaaattagctttactcaacatgccccgagtcaggaaactaaaatacctcttggtctaggtagacactttcactggataggtacaggcctttcccacagggtctaagaaggccaccacggtcacttcttcccttctgtcagtcaaaattactcggtttggccttcccacctctaggcagtccaatagtagaccggcctttattcatcaaatcagccaagcagtttttcaggctcttggtattcagtgaaacctttatatcccttacagtcctcagtcttcaggaaaggtagaatggactaatggtcttttaaaaacacacctcaccaagctcagtcaccaacttaaaaaggactagacagtacttttacctctttcttttctcagaatttaggcctgtcctcagaatgctacagggtacagcccatttgagctcctgtatggacgctccattttattaagccccagtctcattccagacatcagaccaacttggactgtgccccaaaaacttgtcatccctactatcttctgtctagtcatactcctattcaccgttctcgactactcatatatgccctgctcttgtttacactgccggtttacaccgtttctccaagccatcacagctgatatctcctggtgctatccccagactgccactcttaactcttaaagtaaataaataatctttgctggcaaggctatgctgaacctccttaggcactctctaattagatgtcctaagtcctcccaattcttagtcctttaatacctgtttttctccttctcttattccctttagtttttcaatacatacaaaaccgtatccaggccatcaccaataattctaaatgacaaatatttcttctaacagtcccacaatgtcaccccttaccacaaaatcttccctcagcttaatctctcccactctaggttcccatgctacccctaatcccgctcaaagcagccctgagaaacatcgcccattatctctccatactatccccccaaattttcgccatcccaacactttaccactatttcgttttatttttctcattaatataagaagacaggaatgtcaggcctccgagcccaagctaagccatcatatcccctgtgacctgcacatccacatccagatggccggttcctgccttaactgatgacattccaccacaaaagaaatgaaaatggcctgttcttgccttaactgatggcattatcttgtgagattccttctcctggctcatcctggctcaaaagctcccctactgagcaccttgtgacccccactcctgcctgccagagaacaacccccctttttcctttacctacccaaaccctataaaacagccccacccctatctcccttcactgactctcttttcggacacagccctgcacccaggtgaaacaaacagccttgttgctcacacaaagcctgtttggtggcctcttcacagggacgcaagtgaaa

SEQ ID NO: 98 - DNA, 67 bp, Homo sapiens
atatggacagcccaccccaagggaagaatcagaggagaagggacacaagaccccagaaacacacaaa

SEQ ID NO: 99 - DNA, 5531 bp, Homo sapiens
gtcaggtctctgagcccaagctaagccatcatatcccctgtgacctgcacgtacacatccagatggccggttcctgccttaactgatgacattccaccacaaaagaaatgaaaatggcctgttcctgccttaactgatgactttatcttgtgaaattccttctcctggctcattctggctcaaaagctcccctactgagcaccttgtgacccccactcctgcctgccagagaacaaccctcctttttcctttacctacccaaatcctataaaacagccccacccctatctcccttcgctgactctcttttcggactcagcccacctgctcccaggtggaataaacagctttattgctcacacaaagcctgtttcatggtctcttcacacgaacacaagtgaaatttggtgccgtgactcagatcgggggacctcccttgggtgatcaatcccctgtccttctgctctttgctctgtgagaacgatccacctatgacctcaggtcctcagactgaccagcccaagaaacatctcaccaatttcaaatccggtaagcagcctctttttactctcttctccaacctccctcactatccctcaaactctttctcctttcaatcttggtgccacacttcaatctctcccttctcttaatttcaattcctttcattttctggtagagacaaaggagacacgttttatctgtggacccaaaactctggtgccagtcacggactagggaaggcagccttcccttggtgtttaatcattgcagggatgcctctctgattattcacccaggtttcagaggtgtcaaaccacgcaaggatgcctgccttggtccttcacccttagcagcaagtcctgcttttctgggggaggggcaagaatcccaaccccttctctccgtgtctctaccccttctctgcttttctgggggaggggcgagaacccctcaaccccttctccttcacccttagcggcaagtcccgcttttctgggggaggggcaggaaccctgacctcttatctctgcaccctgatccctcatttccgtgccccaacctcttatctctgcatcccaatctcttatctctgtgccccaaccccttatttctgcccccccgaccccttctctgcttttctggagggcaagaaccccccaccccttctccatgtctctactctcttttctctgggcttgctccttcactatgggcaagcttccaccttccattcctccttcttctcccttagcctgtgttcttaagaacttaaaaccttttcaactctcacctgacctaaaatctaagtgtcttattttcttctgcaatgccgcttgaccccaatacaaactcgacagtagttccaaatagccagaaaatggcactttcaatttttccatcctacaagatctaaataattcttgtcataaaataggcaaacagtctgaggtgcctgacatccaggcattcttttacacattgggccctccctagtccctgttcccaatgcaacttgtcccaaatcttccttctttccctcccgcctgtcccctcagtcccaaccccaagtgtccctgagtctttctaaccttccttttctacagacctatctgacctctcccctcttcaccaggctaagctaagtcccaattcttcctcagcctccgctcctccaccctataatccttttatcacctccccttctcacaccctgtccagcttacagtttcgttctgtgactagccctccccaacctgcccagcaatttcctcttaaaaaggtggctggatctaaagtcatagtcaaggttaatgctcctttttctttatcccaaatcagatagtgtttaggctctttttcatcaaatataaaaacccagcccagttcatggcttgtttggcagcaaccctgagatgctttacagccctagaccctaaaaggtcaaaaggccgtcttattctcaatatacattttatttacccaatctgctcccgacattaaataaaactccaaaaattaaattccggccctcaaactccacaacaggacttaattaacctcgccttcaaggtgtataataatagagaaaagttgcaattccttgcctccactgtgagacaaaccccagccacatctccagcacacaagaacttccaaacgcctgaactgcagtggccaggcattcctccagaacctcctcccccaggagcttgctacgagtgccaaaaatctggccaccaagccaaggaatgcccgcagcccaggattcctcctaagccatgtcccatctttgtggaaccccactgaaaatcggactgttcaactcacctggcagctactcccagagcccctggaactctggcccaaggctctctgactgactccttcccagatcttctcagcttagtggctgaagactgacgctgcccgatcacctaggaagccccgtagaccatcacggacgccaagctttaggtaactctcacagtggaggataagtccatccccttcttaatcaatacggaggctacctactccacattaccttcttttcaagggcctgtttcccttgcctccataactgttgtgggtattgacgggcaagcttcaaaacccctgaaaactccccaactctggtgccaacttggacaatactcttttatgcactcttttttagctatccccacctgcccagttcccttattaggccgagacactttaactaaattatctgcttccctgactattcctggattacagctacatctcattgctgcccttcttcccaatccaaagcctcctttgaatcctcctcttgtatccccccaccttaacccacaagtataagatgcctctactccctccttggtgaccgatcatgcaccccttaccatctcattaaaacctaatcacccttaccccactcaatgccaatatcccatcccacagcacgctttaaaaagattaaagcctgttattactcgcctgctacagcatggccttttaaagcctataaactctccttaccattcccccattttacctgtcctaaaaccagacaagccttacaagttagttcaggatctatgccttatcaaccaaattgttttgcctatccaccccatggtgccaaacccatatactctcctatcctcaatacctccctccacaatccattattctgttctagatctcaaacatgctttctttactattcctttgcacccttcatcccagcctctcttcgctttcacttggactgaccctgacacccatcaggctcagcaaattacctaggctgtactgccgcaaagcttcacagacagcccccattacttcaatcaagcacagatttcttcctcatctgttacctatctcagcataattctcataaaaacacatgtgctctccctgctgattgtgtccggctaatctcccaaaccccaatcccttctacaaaacaactcctttccttcctaggcatggttagtgcggtcagaattcttacacaagagccaggactgcaccctgtagcctttctgcccaaacaacttgaccttactgttttagcctagccctcatgtctgtgtgcagcagctgccactgctttaatacttttagaggccctaaaaatcacaaactatgctcaactcactctccacagttctcataacttccaaaatctattttcttcctcccacctgacgcatataatttctgctcccaggctcctttagctatactcactcttcattgagtctcccacaattaccattgttcctggcccagacttcaatctggcctcccacattattcctgataccacacctgatccccatgactgtatctctctgctccgcctgacattcaccccatttccccgcatttccttctttcctgttcctcaccctgatcacacttagtttattgatggcagttctgccaggcctaatcaccacacaccagcaaaggcaggctatgctatagtacaagccactagcccgcctcttagaacctctcatttcctttccatcgtggaaatctatcctcaaagaaataacttctcagtgttccatctgctatactactacttctcggggattattcaggccccctcccttccctacacatcaagctcggggatttgcccccacccaggactggcaaattggctttactcaacatgctccgagtcagaaaactaaaatacctcttagtctaggtagacactttcactggataggtagaggcctttcccacagggcctaaggaggccaccacagtcatttcttctcttctatcagatgtaattcctcagtttggccttcccacctctatacagtccaatagcagaccggcctttactagtcaaatcacccaagcagtttctcaggctgctagtattcagtgaactaatggtcttttaaaaacacacctcaccaagctcagccaccaacttaaaaaggactagacaatttcccttctcagaattcaggcctgtcctcagaatgctataaggtacagcccatttgagctcctgtatagacgctcctttttattaggccccagtctcattccagacaccagaccaactcggactgtgccccaaaaaacttgtcatccctactatcttctgcctagtcatactcctattcactgttctcaactactcatacatgccctgctcttgtttccactgccggtttacactgtttctccaagccatcacagctgatatctcctggtgctatccccaaactgccactcttaactcttaaacaaataatctttgctggcaggactatgctgaatctccttaggcactctaattagatgtcctgggtcctcccaattcttagacttttaatacctgtttttctccttctcttattccatttagtttttcaattcatataaaactgtatccaggccatcaccaataattctaaatgacaaatgtttcttctaacagtcccacaatatcaccccttaccacaaaatcttccttcagcttaatctctcccactctacgttcccacgccacccctaatcccgctcaaagcagccctgagaaacattgcccattctctctccataccacccccaaaaattttcaccatctcaacactttaccactatttcattttatttttcttattaatataagaagacaggaatgtcaggcctctgagcccaagctaagctatcatatcccctgtgacctgcacgtacacatccagatggccggttcctgctttaactgatgatattatcttgtgaaattccttctcctggctcatcctggctcaaaagctcccctactgagcaccttgtgacccccactcctgcttgtcagagaacaacccccctttttcctttacctacccaaatcctataaaatggttccacccctatctcccttcgctgactcttttcggactcagcccacctgcacccaggtgaaataaacagctttattgctcacacaaagcctgtttggtggtctcttcaaacagacgcgagtgaaa

SEQ ID NO: 100 - DNA, 990 bp, Homo sapiens
aagaacacgtgagaaagtgtggggaaaagaaagagaaatcagattgttactgtgtctatgtagaaaaggaaacataagaaactccattttgatctgtattaagaaaaattgtttctgctttgagatgctgttaacttgtaactttatccccaaccctgtgctcacagaaacatgtgctgtattggatcaaagtttaatggatttaggactgtgcaggatgtgccttgttaatatgtttgcaggcagtatgcttggtaaaagtcatcgccattctccattctctgttaaccaaggacacaatgcactgtggaaagccacagggacctctgcccaagaaagcctgggtattgtccaacgtttcccccaactgagacagcctgagatatggcctcatgggaaaggaaagaccttaccatcccccagcccgacacccataaagggtctgtgctgaggaggaggagtgaaagagggaggcctctttgcagttgagataagaggaaggcttctctgctcatccctgggaatggaatgtctctgtgtaaagccgaccattcccattcattctattctgagataggagaaaaccgccctgtggctggaggcgagatatgctggcagcaatactgctctgttgctctttgctacactgagatacttgggtaaagagaaacataaatctagccttcgtgcacatccgggcacagtatctttccttgaacttactcatgatacagattcctttgctcacatgtttccctgctgaccttctccccacctgttgccctgctacactccccttgctaagatagtaaagatcatgatcaataaatactgagggaactcagaggctggcgccggtgcgggtccttcgtatgctgagcgccagtgccctgggcccactgttctttctctgtactttgtccctgtgtctatttcttttctcagtctctcatcccacctgacgagaaatacccacaggtgtgaaggggc

SEQ ID NO: 101 - DNA, 5698 bp, Homo sapiens
gttaggcctctgagcccaagccaagccatcgcatcccctgtgacttgcacatatatgcccagatggcctgaagtaactgaagaatcacaaaagaagtgaaaaggccctgccccgccttaactgatgacattccaccactgtgatttgttcctgccccaccttaactgagtgattaaccctgtgaatttccttctcctggctcagaagctaccccactgagcaccttgtgacccccgcccctgcccaccagagaacaacctcctttgactgtaattttccattaccttcccaaatcctataaaacggccccacccctatctcccttcgctgactctcttttcggactcaaccgcctgcacccaggtgaaataaacagccatgctgctcacacaaagcctgtttggtagtctcttcacacggacacacatgaaatttggtgccatgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttactatcttctccagcttccctcactatccctcaacctctttctcctttcaatcttggcaccacacttcaatctctcccttctcttaatttcaattcctttcattttctggtagagacaaaggagacacgttttatccatggacccaaaactccggtgccggtcacggactgggacggcagccttcccttgatgtttaatcattgcagggacacctctctgattattcacccacgtttcaaaggtgtcagaccacgcagggacacctgccttggtccttcacccttagcggcaagtcccgcttttctggggaaggggcaagtaccccaaccccttctctccttgtctctaccccttctctgcttttctgggggaggggcaagaacccctcaaccccttctccttcacccttagtggcaagtcccacttttctgggggaggggcaagtacccctcaaccccttctccttcacccttagcagcaagtcccacttttctagggggcaagaacccccaatcccttatttccgctccccaacctcttatctctgtgccccaattccttatttccatgccccaaccctttctctgcttttctggagggcaaggaacccctaccccttctctgtgtctctactcttttctctgggcttgcctccttcactatgggcaagattccaccttacattcctcctccttctcccttagcctatattcttaagaacttaaaacctctccaactttcactgacctaaaatctaagcgtcttattttcttctgcaatgccgcttgaccccaatacaaacttgacagtagttccaaacaccggaaaatggcactttcaatttttccatcctacaagatctaaataattcttgtcgtaaaaggggcaaatggtctgaggtgcctgacgtccaggcattcttttacacatcagtcccttcctagtctctgtgcccagtgcaactcatcccaaatcttccttctttccctcccgcctgtcccctcagtcccaaccccaagcgtcgctgagtctttctaatcttccttttctatagacccatgtgacctctcccctcctcaccaggccaagctaggtcccaattcttcctcagcctctgctcctccaccctgtaatctttttatcgcctcccctcctcacacctggtccggcttacagtttccttctgtgactagccctccccaacctgcccagcaatttactcttaaaaaggtgactggagccaaaggcatagtcaaggttaatgctcatttttctttatcccaaatcagaagcgtttaggctctttttcatcaaatataaaaacccagcccagttcatggcttgtgtggcagcaaccctgagatgctttacagccctagaccctaaaaggtcaaaaggccatcttattctcaatatacattttattacccaatctgctcccgacattaaataaaactccaaaaattagaatctggccctcaaaccccacaacaggacttaaccttaccttcaaggtgtacaataataaaaaaaaagttgcaactccttgcctccactgtgagacaaaccccagccacatctccagcacacaagaacttccaaacgcctgaaccgcagcagccaggcgttcctccagaacctcctcccccaggagcttgctacaagtgccagaaatctggccaccaggccaaggaatgcctgcagcccaggattcctcctaagccgtgtcccatctgtgcgggaccccatgggaaatcggactgttcaactcacctggcagccactcccagagcccctggaactctggcccaaggctctctgactgactccttcttggcttagcggctgaagactgatgctgtctgattgcctcggaagccccatagaccatcacggatgctgagctttaggtaactctcagagtggagggtaagtccgtccccttcttaatcaatacgaaggctacccactccacattaccttcttttcaagggcctgtttcccttgcctccataactgttgtgggtattgacagccaggcttctaaacctcttaaaactccccaactctggtgccaacttagacaatactcttttaagcactcttttttagttatccccacctgcccagttcccttattaggccgagatattttaaccaaattatctgcttccctgactattcccggactatagccgcatctcattgctgccgttcttcccaatccaaagcctcctttgcgtcctccttttgtattcccccaccttaacccacaagtataagatacctctactccctccttggcgaccgatcacgcaccccttaccatctcattaaaacctaatcaccctcaccccactcaatgccaatatcccatcccacagcatgctttaaaaggattaaagcctgttatcactcgcctgctacagcatgggcttctaaaacctataaactctccttaccattcccccattttacctgtcctaaaaccagacaaggcttaaaagttagttcagaatctgcgccttatcaaccaaattgttttgcctatccaccccgtggtgccaaacccatatactctcctatcctcaaaacctccgtctacaatccattattctgttctggatctcaaacatgctttctttactattcctttgcacccttcatcccagcctctctttgccttcacttagactgaccctgacacacattaggctcagcaaattacctgggctgtactgccgcaaggcttcacagacagcccccgttacttcagtcaagcccaaatttcatcctcatctgttacctatcttggcataattctcataaaaacacaggtgctctccctgctgatcatgtccaattaatctccaaaacctcaatcccttacaaaacaacaactcctttccttcctaggcatggttagtgtggtcagaattcttacacaagagccaggaccacaccgtgtagcctttctgtccaaacaaattgaccttactgtcttagcctagccctcatgtctgcatgcagcggctgccgctgctttaatactgttagaggccctaaaaaatcacaaactatgctcaactcactctctacatttctcgtaacttccaaaatctattttcttcctcatacctgacgcatatactttctgctccccagctccttcagctgaactcactctttaagtcccacaactaccattgtttctggcccggacttcaatctggcctcccacattattcctgataccacacctgacccccatgactgtatctctctgatccacctgatattcaccccatttccccatatttccttctttcctgtccctcaccctgaacacacttggtttattgatggcagttccaccaggcctaatcgccacacaccagcaaaggcaggctatgctatagtacgagccactagcccgcctctcagaacctctcatttcctttccatcgtggaaatctatcctcaaggaaataacttctcagtgttccatctgctattctactactcctcagggattattcaggccccctcccttccctacacatcaagctccaggatttgcccccacccaggacgggcaaattagctttactcaacatgtcccgagtcaggaaactaaaatagctcttagtctaaatagacgctttcactgaataagtaatggcctttcctacagggtctgagaaggccaccacagtcatttcttcccttctgtcagacataattcctcagtttagccttcccacctctatacagtctgataacagaccagcctttattagtcaaatcagccaagcagtttttcaggctctcagtattcagtgaaacctttatatcccttatggtcctccgtcttcaagaaaagtagaacggactaaaggtcttttaaaaacacacctcaccaagctcagccaccaacttaaaaaggactggacaatacttttaccactttcgcttctcagaattcaggcctgtcctcagaatgctacaaggtacagcccatttaagctcctgtatagacgctcctttttattaggccccagtctcattggacaccagaccaacttagactgtgccccaaaaaaacttgtcatccctactatcttttgtctagtcatactcctattcaccattctcaactactcatacatgccctgctcttgtttacactgctggtttacactgtttctccaagccatcacagctggtatctcctggtgctatccccaaactgccactctaaactcttgaagtaaataaataatctttgctggcaggactatggtgaatctccttaggcactctctaatcagatgtcctagctctcccaattcttagactttttatacctgtttttctccttctcttattccatttagtttttcaattcatacaaaaccgtatccaggccatcaccaatcattctatatgacaaatgtttcttctaacaaccccacaatatcaccccttaccacaagacctcccttcagcttaatctctcccactctaggttcccacactgcccctaatcctgttgaagcagccctgagaaacatcgcccattctctctccataccacccccaaaaattttcgccgccccaacacttcaacactattttgttttatttttcttattaatataaggaagcaggaatgtcaggcctctgagcccaagccaagccgtcgcatcccctgtgagttgcaggtatacgcccagatggcctaagtaactgaagaatcacaaaagtgaaaaggccctgccccgccttaactgatgacattccaccattgtgatttgttcctgccccaccttaactaagtgattaaccgtgtgaatttccttctcctggctcagaagctcccccactgagcaccttgtgaccccgcccctgcccaccagagaacaaccccctttgactgtaattttccattaccttcccaaatcctataaaacggtcccacccctatctcccttcgctgactctctttttggactcagcccacctgcacccaggtgaaataaacagccatattgctcacacaaagcctgtttggtggtctcttcacacggacccgcatgaaa

SEQ ID NO: 102 - DNA, 5868 bp, Homo sapiens
gtcaggcctctgagcccaagccaagccatcgcatcccctgtgacttgcacatatacgcccagatggcctgaagtaactgaagaatcacaaaagtgaatatgccctgccccaccttaactgatgacattctaccacaaaagaagtgtaaatggccactccttgccttaagtgatgacattaccttgtgaaagtccttttcctggctcatcctggctcaaaaagcacccccactgagcaccttgcgacccccactcctacctgacagagaacaaaccccctttgactgtaattttcctttacctacccaaatcctataaaacggccccacccttatctccctttgctgactcttttcagactcagcctgcctgcacccaggtgaaataaacagccttgttgctcacacaaagcctgtttggtggtctcttcacacagacgcgcatgaaatttggtgccgtgactcggatcaggggacctcccttaggagatcaatcccctgtcatgttctttgctccgtgagaaagatccacctacaacctcaggtcctaagaccgaccagcccaagaaacatctcaccaatttcaaatccggtaagcggcctctttttactctcttctccaacctccctcactatccctcgacctctttctcctttcaatcttggtgccacacttcaatctctcccttctcttaatttcaattcctttcattttctgggagagacaaaggagacacgttttatccgtggacccaaaactccggtgccagtcacagactgggaaggcagccttcccttgacctttaatcattgcagggatgcctctctgattattcacccacgtttcaaaggtgttagaccacgcagggatgcctgccttggtccttcacccttagcggcaagtcccgcttttctggggaaggggcaagtaccccaacccctcctctccttgtctctaccccttctctgcttttctgggggaggggcaagtacccctcaaccccttctccttcactcttagcagcaagtcctgcttttctagaggaggggcaagtaccccaacctcgtatctctgtgccccaatcccttatttccgtgccccaacctcttatatctctgtgccccaatcccttatttctgtgccctaacttaactctgcgccccaatcctttatttccgtgccccgaccccttatttccgtgccccaccccttatttccatgccctgaccccttatttctgcaccccatcccttatttccacgccctgacctcttatctctgcgccccaaccccttttctggaaggtaagaaccccgaaccccttccctccgtttctctgctctctcttttctctaggcttgcttccttcactataggcaaccttccaccctccattcctccttctactcccttggcctgtgttctcaaaaacttaaaacctcttcaactcacaccttacctaaaacctaaatgtcttattttcttctgcaatgccacttgaccccaatacaaactctacagtagttccaaatagccagaaaatggcactttgaatttttccatcctacaagatctaaataattcttgttgtaaaataggcaaatggtctgaggtgcctgacgtccaggcattcttttacacatcagtcccttcctagtctgtgcccagtgcaactcgtcccaaatcttccttctttccctcccgcctgtcccctcagtcccaacaccaagcgtcgctgagtctttctaatcttccttttctacagacccatctgacctctcccttcctccccaggctactccctgccaggccgagctaggtcccaattcttcctcagcctctgctactccaccctataatctttttatcacctcccctcctcacacctggtctggcttacagtttagttctgtgactagccctccccctcctgcccagcaatttactcttaaaaaggtggctggagctaaagccatagtcaaggttaatgctcatttttctttatcccaaatcagatagcgtttaggctctttttcatcaaatataaaaatccagcccagttcatgacttgtttggcaacaaccctgagacactttacagccctagaccctaaaaggtcaaaaggccgtcttattctcaaaatacattttattacccaatctgctcctgacattaaatataactccaaaaattaaattctggccctcaaaccccacaacaggatttaattaacctcgccttcaaggtgtacaataatagaaaaaagttgcaattccttgcctccactgtgagacaaaccccagccccatctccagcacacaagaacttccaaacgcctgaaccgcagtggccaggcgttcctccagaacctcctcccacaggagcttgctacacgtgccggaaatctggccactgggccaaggaatgcccgcagcccgggattcctcctaagccccgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacggacgctgagcttcaggtaactctaacagtggaaggtaagcccgtccccttcttaatcaatacggaggctacccactccacattaccctcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactaactaaattatctgcttccctgactattcctggactacagctgtatctcattgccacccttcttcccaatccaaagcctcctttgcgtccccctcttgtatccccccaccttaacccacaagtataagatacctctactcccttcttggcaaccgatcatgcaccccttaccatctcattaaaacctaatcacccttaccccactcaacgccaatatcccatcccgcagcatgctttaaaaagattaaagcctgttatcactcgcctgctacagcatggccttttaaagcctataaactctccttaaaattcccccattttacctgtcctgaaaccagacaagccttacaagttagttcaggatctgcatcttatcaaccaaattgttttgcctttccaccccatggtgccaaacccatatactctcatatcctcagtacctgcctctacaacccattattctgttctagatctcaaacatgctttctttactatccctttgcacccttcatcccagcctttcttcgctttcacttggactgaccctgacacccatcaagctcagcaaattacctaggctgtactgccacaaagcttctcagacagcccccattacttcaatcaagcccaaatttcttcctcatctgttacctatctcggcataattctcataaaaacacacgtgctctccctgccaatctgtctgactgatctctcaaacccaagcaccttctacaaaacaacaactcctttccttcctaagcacggttagcgcagtcagaattcttacacaagagccaggaccacatcctgtagcccttctgtccaaacaacttgaccttactgttttagcctagccctcatgtctgcgtgcagcggctgctgctgctttaatacttttagaggccctcaaaatcacaaactatgctcaactcactctctacagttctcataacttccaaaatccattttcttcctcatacctgacgcatatactttctgcttcccggcgccttcagctgtactcactctttgttgagtctcccacaattaccgttgttcctggcccagactccaatccggcctctcgcattattctggataccacacctgacccccatgactgtatctctctgatccacctgacattcaccccatttccccaaatttccttctttcctgttccttaccctgatcacgcttgatttattgatggcagttccaccaggcctaatcgccacacaccagcaaaggcaggctatgctatagtacaagccactagcctgcctcttagaacctctcatttcctttccatcgtggaaatctatcctcaaggaaataacttctcagtgttacatctgctattctactactcctcagggattattcaggccccctcccttccctacacatcaagctcgaggatttgctcccacccaagactggcaaattagctttactcaacatgccccgagtcagataactaaaatacctcttagtctaggtagacactttcactggataggtagagtcctttcctacagggtctgagaaggccactgcagtcatttcttcccttctgtcagacataattcctcagtttagccttcccacctcaatacagtctgacaacagacaagcctttattagtcaaatcagccagcagtttttcaggctcttagtattcagtgaaacctttatatcccttacggtcctccatcttcaagaaaagtagaatagactaaaggtcttttaaaaacacacctcaccaagctcagccaccaacttaaaaaggactggacaatacttttaccactttcctttctcagaattcaggcctgtcctcggaatgctacagggtacagcccatttaagctcccgtacagacgctccttattaggccccagtctcattcgagacaccagaccaacttagactgtgccccagaaaacctgtcatccctactatcttctgtctactcatactcctattcaccgttctcaactactcatacatgccctgctcttgtttacactgccagtttacactgtttttccaagccatcacagctgatatctcctggtgctgtccccaaactgccactcttaactcttgaagtaaataaataatctttgctggcaggactatgctgaatctccttaggcgctctctaatcagatatcctgagtcgtcccaattcttagaccttttatacctgtttttctccttctgttattccatttagtttctcaattcatccaaaaccgtatctaggccatcaccaatcattctacacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccatatcaccccccaaaaatttttgctgccccaacacttcaacactattttgttttatttttcttattaatataagaagtcaggaatgtcaggcctctgagcccaagccaagccatcgcgtcccctgtgacttgcacatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactcctgcccgccagagaacaaacccccttggactgtaattttcctttacctacccaaatcctataaaatggccccacccttatctccctttgctgattctcttttcggactcagcccacctgcacccaggtgaaataaacagccatgttgctcacacaaagcccgtttggtggtctcttcacacggacgtgcatgaaa

SEQ ID NO: 103 - DNA, 5785 bp, Homo sapiens
gtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccaactcctgcgcactgagcaccttacgacccccactcctacccgccagagaacaaaccccctttgactgtaattttcctttacctacccaaatcctataaaacggccccacctttatctccctccgctgactctcttttcggactcaggcgcctgcacccaggtgaaataaacagccatgttgctcacacaaagcctgttttgtggtctcttcacacggacgcgcatgaaatttggtgccatgactcggatcgggggacctcccttgggagatcaatcccctgtcctcctgctctttgctccgtaagaaagatccacctacgacctcaggtcctcagacctaccagcccaggaaacatctcaccaatttcaaatccggtaagcggcctctttttactctcctctccaacctccctcactatccctcaacctctttctcctttcaatcttagcgccacacttcaatctctcccttctcttaatttcaattcctttcattttctggtagagacaaaagagacatgttttatccgtgaacccaaaactccggcgccggtcacagactgggaaggcagccttcccttggtgtttaatcattgcagggacgcctctctgattatacactcatgtttcaagggtgtcagaccacgcagggacacctgccttggtccttcacccttagcggcaagtcccgctttcctggggcaggggcaagtacccctcaaccccttcttcttcacccttagaggcaagtcctgctttcctagggggcaagaagcccccaatcgcttatttccgcaccccaacctcttatctctgtgccccaatcccttatttccgtaccctgacctcttatctctgtgccccaatcccttatttccatgccccaaccccttttctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaaaatctaaataattcttttcgtaaaataggcaaacggtctgaggtgcctgacatccaggcattcttttacacatcagtcccttcctagtctctgtgcccagtgcaactcgtcccagatcctccttctttccctcccgcctgtcccctcagtcccaaccccaagcatcgctgagtcttcccagtctttcttttctacagacccatctgacctttcccctcctccccaggctgctcgtcgccaggctgagctaagtcccaatacttcctcagcctccactcctccaccctataatccttctatcacctcccctcctcacacccggtccggcttacagtttagttccacaactagctcttccccacctgcccagcaatttactcttaaaaaggtggctagagccaaaggcataatcaaggttaatgctcctttttctttatcccaaatcagatagcgtttaggctctttttcatcaaatataaaaacccagcccagttcatggctcgttcggcagcaaccctgagacactttacagccctagaccctaaaaggtcaaaaggccatcttattctcaatatacattttattacccaatctgctcccgacattaaataaaactccaaaaattaaattccagccctcaaaccccacaacaggatttaattaacctcgccttcaaggtgtaaaataatagaaaaaagttgcaattccttgcctccactgtgagacaaaccccagccacaatctccagcacacaagaacttccaaatgcctgaaccgcagtggccaggcgttcctccagaacctcctcccacaggagcttgctacatgtgccggaaatctggccactgggccaaggaatgcccgcagcctaggattcctcctaagccatgtcccatctgtgtgggaccccactgaaaatcggactgttcaactcacctggcagccactcccagcttccctggaactctggcccaagcctctctgactgactccttcccagatcttctcggcttagcagctgaagactgacactgcctgatcgcctcgggagccccctagaccatcacggacgccgagcttcgggtaactctcacagtggagggtaagcccgtccccttcttaatcaatacggaggctactcactccacattaccctcttttcaagggcctgtttcctttgccgccataactgttgtgggtattgacggccaggcttctaaacctcttaaaactccccaactctggggccaacttagacaatactcttttaagcactcctttttagttatccccacctgcccagttcccttattaggctgagacactttaactaaattatctgcttccctgactattcctggactacagctgtatctcattgccgcccttcttcccaatccaaagcctcctttgcgtcctccaaagcctcctttgcgtcctcctcttctatcccccaaccttaacccacaagtataagatacctctactccctccttggcgactgatcatgcaccccttaccatctcattaaaacctaatcactcttaccccactcaacaccaatatcccatcccgcagcatgctttaaaaagattaaaggctgttatcactcgcctgctacagcatggccttttaaagcctataaactctccttacaattcccccattttacctgtcctaaaaccagacaagccttacaagttagttcaggatctgcgccttatcaaccaaattgttttgcctatacaccccatggtgccaaacccatatactctcctatcctcaatacctgcctctacaacccattattctgttctggatctcaaacatgctttctttactattcctttgcacccttcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgccgatcctgtccgattaatctcccaaacctcaatcccttacaaaacaacaactcctttccttcctaggcatggttagtgtggtcagaattcttacacaagagccaagaccgcaccctgtagcctttctgtccaaacaacttgaccttactgttttagcctagccctcatgtctgtgtgcagcagctgccgctgctttaatacttttagaggccctaaaaatcgcaaactatgctcaactcactctctacatttctcataacttccaaaatctattttcttcctcatacctgacgcatatactttctgctccccggctacttcagctgtacccactctttgttgaggctcccacaattaccgttgttcctggcccagacttcaatccagcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcaggttatgctatagtacaagccactagcccgcctcttagaacctctcacttcctttccatcgtggaaatctatcctcaagcaaataacttctcagtgttccatctgctgttctactactcctcagggattattcaggacccctcccttccctacacatcaagctccaggatttgccccacccaggactggcaaattagctttactcaacatgccctgagtcagataactaaaatacctcttagtctaggtagatactttcactggataggtagaggcctttcctacagggtctgagaaggccaccgcagtcatttcttccattctgtcagacataattcctcagtttagccttcccacctcaatacagtctgataacagacgagcctctattagtcaaatcagccaagcagtttttcaggctcttagtattcagtgaaacctttatatccctttatggtcctccatcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaacgtcctgtatagacgctcctttttattaggccccagtctcattccagacaccagaccaacttagactgtgcctcaaaaaaaaaaaaaaacttgtcatccctactattttctgtctagtcatactcctattcaccgttctcaactactcatacatgccctgctcttgtttacactgccggtttacactgtttttccaagcgatcacagctgatatctcctggtgctagccccaaactgccactcttaactcttgaagtaaataaataatctttgctggcaggactatgccaaatctccttaagcactctctaatcagacctcctgagtcgtcccaattcttagaccttttatacctgtttttctccttctgttattccatttagtttttcaattcatacaaaaccgtatccaggccatcaccaatcactctatatgacaaatgtttcttctaacatccccacaatatcaccccttaccacaagacctcccttcagcttaatctctcccactctaggttcccacgccgcccctaatcccgcttgaagcagccctgacaaacatcatccattctctctccataccaccccccaaaaattttcgccgccccaacactgcaacactattttgttttatttttcttattaagaaggcaggaatgtcaggcctctgagcccaagccaagccatcacatcccctgtgacctgcacgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcccggctcatcctggctcaaaagcacccccactgagcaccttgcgaccccaactcctgcgcactgagcaccttacgacccccactcctacccgccagagaacaaaccccctttgactgtaattttcctttacctacccaaatcctataaaacggccccacccttatctccctccgctgactctcttttcggactcagcccgcctgcacccaggtgaaataaacagccatgttgctcacacaaagcctgtttggtggtctcttcacatggacgcgcatgaaa

SEQ ID NO: 104 - DNA, 5612 bp, Homo sapiens
ctgccttaaatgatgacattccaccacaaaagaagtgaaaatggcctgttcctgccttaactgatgacattgtcttgtgaaattccttctcctggctcatcctggctggaaagctcccctactgagtatcttgtgacccccactctggccaccagagaacaaccccgctttgactgtaattttcctttatttacccaaatcctataaaacgtccccacccttatctcccttggctgaccctcttttcggactcagcccagctgcacccaggtgaaataaacagctttattgctcacacaaagcctgtttggtggtctcttccatggatgcaagtgaaatttggtgccatgactcggatcagggtacctcccttgggagatcaatcccctgtcctcctgctctttgctccatgagaaaggtccacctatgacctcaggtcctcagaccgaccagcccaagaaacatctcaccaatttcaaatccagtaagcagcctatttttactctcttcttcaacctccctcactatccctcaacctcgttctcctttcaatcttggcgccacacttcaacctctcccttctcttaatttcaattcctttcattttctggtagagacaaaggagacattttatccgtggacccaaaactccagcgcctgtcacagactgggaaggcagccttcccttggtgtttaatcattgcagggacacctctgattattcactcatgtttcagaggtgtcataccatgcaaggatgcctgccttggtccttcacccttagcagcaagtcctgcttttcttggggaggggcaagtaccccaaccccttctctccgtgtctctaccccttctctgcttttctgaaggagaggcaagaacccctcaaccccttctctttcacccttagcggcaagtcccgcttttctaaaggaggggcaagtaccccgacctcttatctctgtgcccccatcccttatttccacaccccgacctcttatctccgtgccccaaccccttatttctgtgccttgaccccttttctgcttttctggaaggtaagaactcccaaaccccttccctctgtgtctctactctctcttttttctaggcttgcctccttcactataggcaaacttccaccctccattcctcctccttctcccttagcctgtgttcttaagaacttaaaacctattcagctctcacctgacctaaaatctaagcgtcttattttcttctgcaatgctgcttgaccccaatacaaactcacagtagttccaaatagccagaaaacggcactttcaatttttccatcctgcaagatctaaagaattcttgtggtaaaataggcaaacggtctgaggtgcctgacgtccaggcattcttttacacatcagtcccttcctagtctctgtgcccagtgcaactcatcccaaatcttccttctttccctcccgcctgtcccctctgtcccaaccccaagcgtcgctgagtctttctaatcttccttttctacagacccatctgacctctcccctcctccccaggctgctcctcgccaggccaagctaggtcccaattcttccccagcctccagtcctccaccctgtaatctttttatcacctcctctcctcacacccggtccagtttacagtttaattccgtgagtagccctcccctacctgcccagcaatttcctcttaaaaaggtggctaaagctaaaggcatagtcaaagttaatgctcctttttctttatcagacctctcccaaatcagtgagcatttaggctgtttcatcaaatatgaaaaacccagcccagttcatggcttattcggcagcaaccctgagacgctttacagccctagaccctaaaaggtcaaaaggccgtcttattctcaatatacattttattacccaatctgctcccgacattaaataaaactccaaaaattaaattctggccctcaaaccccacaacaggacttaattaacctcaccttcaaggtgtacaataatagagtagaggcagccaagtagcaacgtatttctaagttgcaattatttgcctccacggtgagacaaaccccagccacatctccagcacaacaagaactccaaatacctgaaccacagctgccaggggttcctccagaacctcctcccccaggagcttgctacaagtgccggaaatctagccactaggccaaggaaggcccacagcccaagattcctcctaagccatgtcccatctgtgcaggaccccactgaaaattagactgttcaactcacctggcagccacttccagagcccctggaactgtggcccaaggctctctgactgactccttcccagatcttctcagcttagcagctgaagactgacactgcctgatcgcctcagaagcctacaggaccatcacagatgctctaagtaactctcacagtagaaggtaagtccgtccccttcttaatcaatacggaagctactcactccacattaccttattttcaaaggcctgtttcccttgcttccataactgttgtgcgtattgacagccaggcttctaaacctcttaaaactccccaaatctagtgccaacttagacaatactcttttaagcactcctttttagttatccccacctgcccagttcccttattaggccgagacactttaactaaattatctgcttccctgactattcctaggctacagccacacctcattgctgccttttctcccagttcaaagcctccttcacatcctccccttatatctccccaccttaacccacaagtataagacacctctactccctccttagtgaccgatcatgcaccccttaccatcccattaaaacctaatcactcttaccccgctcaatcccaatatcccatcccacagcatgctttgaaaagattaaagcctgttatcacttacctgttacagcatggccttttaaagcctataaactcttcttgccattcccccattttacctgtcctaaaaccagacaaggcttacaggttagttcagaatctgtgccttatcaaccaaattgttttgcctatccaccccatggtgccaaacccatatactctcttatcctcaatacctccctctacaacccattattctgttctagatctcaaacatgctttctttactattcctttgcacccttcatcccagcctctctttgctttcacttaggctgaccctgacacccattaggctcagcaaattacctgggctgtactgccacaaggcttcacagacagcccccattacttcagtcaagcccaaatttcatcctcatctgttacctatctcggcataattctcataaaaacacacgtgctctccctgctgattgtgccaattaatctcccaaacctcaatcccttataaaacaacaactcctttccttcctaggcatggttagtgcggtcagaattcttacacaagagccaggaccgcaccctgtagcctttctgtccaaacaacttgaccttactgttttagcctagccatcatgtctccgtgcagcggctgctgctgccctaatacttttagaggccctcaaaatcacaaactatgctcaactcactctctacatttctcataacttccaaaatctattttcttcctcatagctgatgcatatactttctgctccccggatccttcagctgtactcactctttgttaagtcccacaattatcattgttcctggcccggacttcaatctggcctcccacattatacctgataccacacctgacccccatgactgtatccctctgatccacctgacattcaccccatttccccatatttccttctttcctgtgcctcaccctgatcacacttagtttattgatggcagttccaccaggcctaatcaccacacaccagcaaaggcaggctatgctatagtacaagccactagcccgcctcttagaacctctgatttcctttccatcgtggaaatctatcctcaaagaaataacttctcagtgctccatctgctattctactacttctcaaggattattcaggccccctcccttccctacacatcaaactcaagggtttgcccctgcccaggactagcaaattgactttactcaacatgccctgagtcaggaaactaaaatacctcttggtctaggtacacactttcactagataggtagaggcctttcccacaaggtgtaagaaggccaccacggtcatttcttccctgctgtcagacataattcctcagtttggccttcccacttctacacagtccgatagaagactggcctttgttagtcaaatcagccaagcattttttcaggctcttaatatccagtgaaacctttatatcccttacagtcctcagtcttcaggaaaagtagaacggactaatagtcttttaaaacacacctcaccaagctcagccaccaacttaaaaaggactagataatacttttaccactttcccttctcagaattcaggcctgtcctcagaatgctacaaggtacatcccatttaagctcctgtatagacgctcatttttattaggccccagtctcattccagacaccagaccaacttggactgtgccccaaaaaacttgtcatccctactatcttctgtctagtcattcctattcactgttctcaactactcatacatgccctgctcttgtttacactgccagtttacactgtttctccaagccatcacagctgatatctcctagtgctatccccaaactgccactctaaactcttgaagtaaataaataatctttgctggcaggactatgctgaatctccttaagcactctctaatcagatgtcctaggtcctcccaattcttagaccttttatacctgtttttctccttctcttattccatttagtttttcaattcatacaaaaccatatccaggccatcaccaataattctacaggacaaatgtttcttctaacaaccccacaatatcaccccttaccacaaaatcttccttcagctgaatctctcccactctaggttcccgcgccgcccctaatcccgctcgaagcagccctgagaaacatcgcccattatctctccataccacccccaaaaattttcaccatctcaacactttaccactatttcattttatttgtcttattaatataagaagacaggaatgtcaggcctctgagcccaagctaagccatcatatcccctgtgaccttcatgtacacatccagatggctggttcctgccttaactgatgacattctaccacaaaagaagtgaaaatggcctgttcctgccttaactgatgacattgtcttgtgaaattccttctcctggctcatcctggctcaaaagctcccctactgagcaccttgtgacccccactctgcccaccagagaacaacccccctttgactgtaattttcctttatctacccaaatcctataaaacggccccacccttatttcccttcactgactctcttttcagactcaggccacctgcacccaggtgaaataaacagctttattgctcacacaaagcctgtttggtggtctcttcacagggacatgaatgaaa

SEQ ID NO: 105 - DNA, 5687 bp, Homo sapiens
gtcaggcctctgagcccaagctaagccatcatatcccctgtgacctgcatgtacacatccagatggcctgttcctgccttaactgatgacattccaccacaaaagaaatgaaaatggcctgttcctgccttaactgatgacattatcttgtgaaattctttctcctggctcatcctggctcaaaagctcccctgagcaccttgtgacccccactcctgcctgccagagaacccccctttttcctttacctacacaaatcctataaaacggccccacacctatctcccttagctgactctcttttcaggctcagcccgcctgcacccaggtaaaataaacagccttgttgctcacacaaagcctgtttggtggtctcttcacacggacgcacatgaaatttggtgccgtgactcggattgggggacctcccttgggagatcaatcccccgtctttgctccctgagaaagatccacctacaacctcaggtcctcagacccaccagcccaaggaacatcacaccaattttaattcaggtaagcagcctctttttactctcttctccaacctccctcactatccctcaacctccttctcctttcaatcttggtgccacacttcaatctctcccttctcttaatttcaattcctttcattttctggtagagacaaaggagacacgttttatcagtggacccaaaactccggtgccggtcatggactagggaaggcagccttcccttggtgtttaatccttgcagggacacctctctgattattcacccaggtttcagaccacgcagggatgcctgccttggtccttcacccttagcggcaagtcccgcttttctgggggaggggcagggaccgcgacctcttatctctgcacccggatcccttatttccatgctccaacctcttatctctgtgccccaaccccttatttccatgcccttctctgcttttctggagggcaagaaccccccaccccttctccgtgtctctactctcttttctctgggcttgcctccttcactataggcaaccttccaccttccgttcctccttcttctcccttagcctgtgttcttaagaacttaaaacctcaactctcacctgacctaaaatctatgcgtcttattttcttctgcaatgctgcttgaccccaatacgaactcgacagtagttctaaatagccagaaaatggcactttcaatttttccatcctacaagatctaaataattcttgtcataaaataggcaaatggtctgaggtgcctgacatccaggcattcttttacacatcagtccttccctagtctctgttccgaatgcaacttttccgaaatcttccttctttccctcctgcctgtccactcagttccaaccccaaccgtcactgagtctttctaatcttccttttctacagacccatctgacctctcccctcctcgctaggctgagctaggtcccaattattcctcagcctccgctcctccaccctataatccttttatcacctcccctcctcacacccagtccggcttacagtttcattcctcgactagccctcccccacctgcccagcgatttactcttaaaaaggtggctggagctaaaggcatagtcaaagttaatgctcctttttcttcatcccagatcagatagcgtttaggctctttttcatcaaatataaaaacccagcccagttcatggcttgtttggcagcaaccctgagatgctttacagccctagaccctaaaaggtcaaaaggccgtctattctcaatatacattttattacccaatccactcctgacattaaataaaactccaaaaattaaattccagccctcaaaccccacaacaggacttaattaacctcaccttcaaggtgtacaataatagagtacaggcagccaagtagcaatgtatttctgagttgcaattccttgcctccactgtgagacaaaccccagccacatctccagcacacaagaactccaaatgcccgaaccgcagctgccaggggttcctccagaacctcctcccccaggagcttgctacatgtgccggaaatctggccactggtccaaggaatgcccacagcctgggattcctcctaagccacgtcccgtcggtgcgggaccccactgaaaatcggactgttcaactcacctggcagccactctcagagcccctggaactctggcccgaggctctctgactgactccttcccagatcttctcagcttagtggctgaagactgacgctgcctgattgcctcagaagccccctagaccatcatggacgccgagcttcgggtaactctcatagtggagggtaagtccatccactccttaatcaatacggaggctacccactccacattaccttcttttcaagggcctgtttcccttgcctccataactgttgtaggtattgacggccaggcttctaaacctcttaaaactccccaactctggtgccaacttagtcaatactcttttaagcactcctttttaattatccccacctgcccagttcccttattaggctgagacactttaactaaatcatctgcttccctgactattcctgggctacagccacaccttattgctgccttttcccccagttcaaagcctccttcacatcctccccttgtatctccccacctaagacacctctactccctccttagcgaccgatcatgcaccccttaccatctcattaaaacctaatcacccttacccctctcaatgccaatatcccatcccacagcacgctttaaaaggattaaagcctgttatcactcgcctgctacagcatggccttttaaggcctataaactctccttacaattccccctttttacttgtcctagaaccagacaagccttacaggttagttcaggatctgcgccctatcaaccaaattgttttgcctatccaccctgtggtgccaaatccatatactctcctatcctcaatacctccctccataacccattattctgttctggatctcaaacgtgctttctttactattcctttgcacccttcatcccagcctctctgctttcacttggactgaccctgacacccatcaggctcagcaaataacctgggctgtactgcaccaagtcttcacagacagcccccattacttcagtcaagcccaaatttcttcctcatctgttacctatctcagcataattcttcataaaaacacatgtgctctccctgccgatagtgtccgactgatctctcaaaccccaaccccttctacaaaacaacaactcctttccttcctaggcatgcttggatactttcgcctttggatacctggttttgccatcctaacaaaaccattatataaactcacaaaaggaaacctagctgaccccatagatcctaaatcctttccccactcctctttccattccttgaagacagctttagagactgcccccaccccagctctccctgactcatcccaacccttttcattacacacagctgaagtgcagggctgtgcagtcggaattctcacacaaggaccaggatcatgtcctgtagcctttttgtccaaacaacttgaccttactgttttaggctggccatcatgcctccgtgcagtggctgctgctgccctaatacttttagaggcccttaaaatcacaaactatgctcaactcactctctacagctctcataatttccaaaatctattttcttcctcacacctgacgcatatactttctgctccctgctccttcagctgtacttactatttgttgagtctcccacaattaccattgttcctggcctggacttcaatccggcctcccacattattccaggtaccacacctgaccctcatgactgcatctctctgatcaaactgacattcaccccatgtccccatatttccttttttcctgttcctcaccctgatcacacttagtttattgatggaagttccatcaggcctaatcaccacacaccatcaaaggcaggctatgctatagtacaagccactagcctgcctcttaaaacctctcatttcctttccatcatggaaatctatcctcaaggaaataacttctcagtgttccatctgctattctactgcttctcagggattattcggtccccctcccttccctacacatcaaactcgaggatttgcccccacccaggactggcaaattagctttactcaacatgccccgagtcagataactaaaatacctcttagtctaagtagacactttcactggataggtagaggcctttcctacagggtctgaggaggctaccgcagtcatttcttcccttctgtcagacataattcctcagtttagcctttccacatctataccgtctgataacagaccagcctttattagtctaatcagccaagcagtttttcagtctcttagtattcagtgaaacctttatatcccttacggtcctcagtctgcaggaaaggtagaacagattaatggtcttttaaaaacacacctcaccaagctcagccaccaacttaaaaaggactggacaatacttttaccactttcgcttctcagaattcaggcctgtcctcagaatgctacagggtacagcccatatgagctcctgtatagacactcctttttattaggccccagtcttattccagacaccagaccaacttggactgtgtcccaaaaaacttgtcatccctactatcttctgtctagtgatactcctattcaccgttctcaactactcatacatgccctgctcttgtttacactgccagtttacagtttctccaagccatcacagctgatatctcctggtgctatccccaaactgccgctcttaactcttgaagtaaataaataatctttgctggcaggactacgctgaacctccttaggcactctctaataagatgtcctgggtcctcccaattcttagacatttaattcctgtttttctccttctcttattccgtttagtttttcaattcatacaaaaccatatccaggccatcaccaataattctacacaacaaatgtttcttctaacaaccccacaatatcaccccttaccacaaaatcttccttcagcttaatctctcccactctaggttcccatgccgcccctaatcccgctggaagcagccctgagaaacatcgcccattatctctccataccatcccccaaaattttctctgtcccaacactttaccactatttcattttatttttcttattaatataagaagacaggaatgtcaggcctctgaggccgagttaagccatcatatcccctgtgacctgcatgtacacatcctgatggcctgttcctgccttaactgatgacattccaccgcaaaagaaatgaaaatggccgttcctgccttaactgatgacattatcttgtgaaattccttctcctggctcatcctggctcaaaagctcccctactgagcaccttatgacccccactcctgcctgccagagaacaaccccgctttttcctttacctacccaaatcctataaaacggccccacccctgtctcccttagctgactcttttcagactcagcccgcctgcacccaggtgaaattaatagccttgttgctcacacaaagcctgtttggtggtctcttcacagggacgtgcatgaaa

SEQ ID NO: 106 - DNA, 6143 bp, Homo sapiens
gtcaggcctctgagcccaagctaagccatcatatcctctgtgacctgcatgtatacatccagatggcctgaagtaactgaagaatcacaaaagaagtgaaaatggcctgttcctgccttaactgatgacattaccttgtgaaattccttctcctggctcatcctggctcaaaagctcccctgctgagcaccttgtgacccccactcctgccagccagagaacaaccccctttgactgtaattttcctttacctacccaaatcctataaaacagccccacccctatctcccttcactgactctcttttcagactcagcccacctgcacccaggtaaaataaatggccttgttgctcacacaaagcctgtttggtggtctcttcacacggacacaagtgaaatttggtgccctgactcggatcgggggacctcccttgggagctcaatcccctgtcctcctgctgtttgctctgtgagaaagatccatctacaaccttgggtcctcagaccaaccagcccaaggaacatctcaccaattttaaatcgggtaagcggcctctttttactctcttctctaacctctctgactatccctcaacctctttctcctttcaatcttggcgccatctttcaatctctgccttctcttaatttcagttcctttccttttctggtagagacaggagacgcattttatccatgaacccaaaactccggcaccactcatggactcaggacgacagtcttcccttggtgtttaatcacgcggggatgcctgcctgattattcacccacgtttcagaggtgtctgaccacatggggatgcctgccttggtccttcacccttagcggcaagcaccacttttctggggggcaagcaccccccgaccccttctctccatgtctctaccctctcttttctgccttggtccttcacccttagtggcaagcaccacttttctggagggcaagcacccccctactccttctctccatgtctctaccccttttccactttcctggggggcaagcaccccccaccccttctttccatgtctctagcctctcttttctctgggcttgcctccttcactatggacaaccttccaccctccattcctccctcttctcccttagcctgtgttctcaaaaacttaaaacctcttcaactcacacctgatctaaaacctaaatgccttattttcttctgcaacactacttggccccaatacaaacttgacaatggctctaaatggccagaaaatggcactttcaatttttccatcctacaagatctagataattcttgtcataaaatgggcaaacggtctgaggtgcctgacgtccaggcattcttttacacattggtccctccctagtctctgttcccaatgcaactcatcacaaatcttccttctttccctccgcctgtcccctcagtcccaatcccaagtgttgctgagtctttccaatcttcctttttttttttttttttttacagacccatctgacctctcccctcctccccaggctgctccttgccaggccgcgccaggttccaattcttcctcagcctccgctcctccaccctataatccttttatcaactcccctcctcacacctggtcccgcttacagtttcattccatgactagccctccccaacctgcccagcaatttcctcttaaaaaggtggctggagctgaaggcatagtcaaggttaatgctcctttttctttacccgacctctcccaaatcagttagcgtttaggctctttttcatcaaatatgaaaaacccagcccagttcttggcccctttagcagcaacccttagactctttacagccctagactcggaagggtcagaagtccatctcattctaaatatgcattttatcacccagccagctcctgacattaaataaaactccaaaaattaaataaattccagccctcaaaccccacaacaggacttaattaacctcactttcaaggtgtacaataatacagtagaggcagccaagtagcaatgtatttctgagttgcaattccttacctccactgtgagacaaaccccagccacatctctagcacacaggagctccaaacgcctgaaccgcagcttccaggggttcctccagaacctcctcccccaggagcttgcttcaagtgccagaaatctggtcactgggccaaggaatgcccgcagcctgggattcctcctaagctgtgtcccatctgtacgggaccccactggatatcagactctccaacttgcccagcagccactcccagagcccctggaactctggcccaaggctctctgactgactccttcccagatctgcttggcttagcggctgaagactgacgcagccccgtcacctcggaagccccctggaccatcacggacgccgagctttgggtaactcttacagtggaaggtaagtccatccccttcttaatcaatacagaggctacacactccacattaccttttcaagggcctgtttcccttgtctccataactgttgtgggtattgacaaccaggcttctaaacctcttaaaactccccaactctggtgccaacttggataacattctttaatgcactgctttttagttaatcccacctgcccagctcccttattaggtctaggcattttaactaaattatctgcttccctgactattcctgggctacagccacacctcattgccaccttttcccccagttcaaagcttccttcacatcctccccttgtatctccccaccttaccccacaagtataggacacctctactccctccttggcgaccaatcatgcaccacttaccatcccattaaaacctaatcacccttaccccactcaatgccaatatcccatcccacagcccactttaaaaggattaaagcctgttatcactcgcctgctacagcatgggcttctgaaacctgtatactctccatacaattcccctattttacatgtccaaaaaccggacaagtcttacaagttagttcaggatctgcgccttatcaatcaaattgttttgcctatccaccccgtggtgccaaacccatgtactctcctatcctcaatacctccctccacaacccattattctgttatggatctcaaacatgctttctttactattcctttgcacccttcatcccagcctctctttgctttcacttggactgaccctgacacccattaggctcagcaaattacctgggctgtactgccacaaggcttcacagataggctcagtcaagcccaaatttcttcctcatctgttacatatcttggcataattctcataaaaacacacgtgctctccctgctgatcatgtccgactaatctcccaaaccccaatcccttctacaaaacaacaactcctttccttcctaggcatggttagtgcagtcagaattcttacacaagagccaggactgtgccctgtagcctttttatccaaacaacttgaccttactgttttagcctagtcctcatgtctgtgtgcagcagctgccactgccttaatacttttagaggacctcaaaatcacaaactatgctcaactcactctctaaaattctcataacttccaaaatctattttcttcctcccacatgatgcatatactttcttctccccagctccttcagctatacttactcattgttgaatctcccacagttccattgttcctggcccagacttcaatccggcctcccacattattcctgataccacacctgacccccatgactgtatctctctgatccacctgacattcactccatttccccatatttccttctttcctgttcactattggtttattgataaaccctgaacactattggtttattgatggcagctccaccaggcctaatcgccacttaccagcaaaggcaggctatgctgtagtatcttccatacctatcattgaggctacctctctgcccccctccactacctctcaaaaagccaaactcattgccttaactcaagccctcgctcttacaaaaggactatgcatcaatatttatactgactctaaatatgccttccatatcctgcaccaccatgctgttatatgggcagaaagaaatttcctcactatgcaagggtcctctatcattaatgcctctttaataaaaactcttctcaaagctgctttacttccaaaggaagctggagtcactcactgcaagggccatcaaaagtcatcagattccatcactcaggacaatgcttatgctgataaggtagctaaaaaagcagctagcgttccaacttctatccctcacggcagtttttctccttctcatctggccactcccacctactctcccactgaaacttccacctatcgatctcttcctacacaaggcaaatggttcttggaccaaggaaaatatctccttccagcctcacaggcccattctattctgtcatcatttcataacctcttccatggaggttacaagctgctagcccacctcttagaacctctcatttcctttcaatcatggaaatctaaccttaaggaaatcacttctcagtgttccatctgctattctactactcctcagggattgttcaggcccccccacttccctacacatcaagctcggggatttgtccccacccaggactggcaaattgactttactcacatgcctcagtcaggaaactaaaatacctcttggtctgggtagacactttcactgggtgggtagaggcttttcccacagggtctgagaaggccactgcagtcatttcttcccttctgtcagacataattcctcagttggccttcccacctctatacagtctgataacagaccagcctttattagtcaaatcactcaagcagtttctcaggctgttggtattcagtgaaacctttatatcccttaccatcctcagtcttcaggaaaggtagaacagactaatggtcttttaaaaacacacctcatcaagctcagccaccaacttaaaaagtaccggacaatacttttaccacttgcccttatcagaattcaggcctgtcctcagaatgctacagggtacagcccatttgagctcctgtatagacgctcctttttattaggccccagtctcattccagacaccagaccaacttagactgtgccccgaaaaacttgtcatccctactatcttctgtctggtcacactcctattcactgttctcaactactcatacaagccctgctcttgtttatgctgccggtttacactgtttctccaagccatcacatctgatatctcctggtgctatctccaaactgccactcttaactcgctcttaaagtaaataaataatctttgctggcagggctatgctgaacctccttgggcactctctaattggatgtcctgggtcctcccaattcttagtcctttaatacctgtttttctcctcttattctgtttagtttttcaattcatacaaaaccgtatccaggccatcaccaataattctatatgacaaatgtttcttctaacaaccccacaatatcaccccttaccacaaaatcttccttcagcttaatctctcccactgtaggtccccacgctgccccaatcccactcaaagcagccctgagaaacatcgcccattatctctccagatcaccccccaaaattttcaccaccccaacacttcaacactattttgttttatttttcttattaatataagaagacaggaatgtcaggcctctgagcccaggctaagccatcatatcctctgtgacctgcatgtatacatccagatggcctgaagtaactgaagaatcacaaaagaagtgaaaatggtctgctcctgccttaactgatgacattaccttgtgaaattccttctcctggctcatcctggctcaaaagctcccccgctgagcaccttgtgacccccccccacccctgccagccagagaacaaccccctttgactgtaatcttcctttacctacccaaatcctataaaacagccccgcccctatctcccttcgctctcttctgattcagcccacctgcacccaggtgaaataaacagccttgttgctcacacaaagcctgtttagtggtctcttcacacggac

SEQ ID NO: 107 - DNA, 4410 bp, Homo sapiens
cttctcccttagcctgtgttcttaagaacttaaaacctcttcaactctcacctgacctaaaatctaagcgtcttattttcttctgcaatgccccttgaccccagtacaaactcgacagtagttctaaatagccagaaaacagcactttcaatttttccatcctacaagatctaaataattcttgtcgtaaaatgggcaaatggtctgaggtgcctgacgtccaggcattcttttacacattggtctctccctagtctctgtgcccagtgggactcgtcccaaatcttccttctttccctcccgcctgtcccctcagtcctaaccccaagcgtcgctgagtctttctaatcttccttttctacagacccacctgacctctcccctcctccccaggctgctcctcgccaggccgagctaggttccaattcttcctcagcctgtctccaccctataatctttttatcacctcccctcctcacacctggtccggcttacagtttcgttccgtgactagccctcccctacctgcccagcaatttactcttaaaaaggtggctggagctaaaggcatagtcaaggttaatgctcctttttctttatcccaaatcagaagcgtttaggctctttttcatcaaatataaaaatccagcccagttcatgactcgtttggcagcaaccctgagacactttacagccctagaccctaaaaggtcaaaaggccgtcttattcttaaaatacattttattatccaatctgctcctgacattaaatgaaactccaaaaattaaattctggccctcaaaccccacaacaggatttaattaacctcaccttcaaggttacaataatagaaaaaagttgcaatttcttgcctccactatgagacaaaccccagccacatctccagcacataagaacttccaaacgcctgaaccgcagtggccaggcattcctccagaacctcctcccccaggagcttgctgcaagtgccagaaatctgaccactgggccaaggaatgcccgcagcccaggattcctcctaagccgtgacccatctgtgtgggaccccactgaaaattggactgttcaactcacctggcagccacttctagagcccctggaactccggcccaaggctctctgactgactccttcccagatcgtcttggcttagcggctgaagactgacgctgcccaatcgcctcagaagccccctagaccatcacggacgccgagctttgggtaactctcacagtggagggtaagtctgtccccgtcttaatcaataccgaggctactcactccacattaccttattttaaacggcctgtttcccttgcctccataactgctgtgggtattgacggccaggcttctaaacctcttaaaactccccaactccggtgctaacttagacaatactcttttaagcactcctttttagttatccccacctgcccagttcccttattaggctgagacactttaactaaattatctgcttccctgactattcctggattacagctgcatctcattgctgcccttcttcccaatccaaagcctcctttgcgtcctcctcttgtattcccccaccttaacccacaagtataaaatacctctactccctccttggcgatcgatcatgcaccccttaccatctcattaaaacctaatcacctttaccccactcaatgccaatatcccatcccacagcatgctttgaaaggatgaaagcctgttatcactcgcctgctatagcatggccttctaaaacctataaactccctttacgatgtccccatttcacctgttctaaaaccagacaaggcttacaggttagttcaacatctgcgccttagcaaccaaattgttttgcctatccaccctgtggtgccaaacccatatactctcctatcctcaataactccctccacaatccattattctgttctagatctcaaacatgctttttttactattcctttgcacccttcatcccagcctctctctgctttcacttggactgaccctgacacccatcaggctcagcaaattacctgggctgtactgctgcaagtcttcacagacagcccccattacttcagtcaagcccaaatttcttccttatctgttacctatctcggcataattctcataaaaacacatgtgctctccctgctgattgtgtccgattaatctcccaaacctcaatcccttacaaaacaacaactcctttccttcctaggcatggttagtgtggtcagaattcttacacaagaggcaggactgcaccctgtagcctttctgtccaaacaacttgaccttactgttttagcctagccatcatgtctccgtgcagtggctgctgccgctctaatacttttagaggccctcaaaatcacaaactatgctcaattcactctccacatttctcataacttccaaaatctattttctttctcatacctgatgcatatgctttctgctccccggctccttcagctgtactcactctttgttaagtcccacaattaccgttgttcctggcccatacttcaatccggcctcccacattattcctgataccacacctgacctccatgactgtatatctctgatccacctgacattcaccccatttccccatatttccttctttcctgttcctcaccctgatcacgcttgatttattgatggcagttccaccaggcctaattgccacacaccagcaaaggcaggctatgccaggcacaagccactagcccacctcttagaacctctcattttctttccatcgtggaaatctatcctcaaggaaataacttctcagtgttccatctgctattctactactcctcagggattattcaggccctctcccttccctacacttcaagctcgaggatttgcccccacccaggactggcaaataagctttactcaacatgccctgagtcagataactaaaatacctcttagtctaggtagacactttcactggataggtacaggcctttcctacagggtctgagaaggccaccgcagtcatttcttcccttctgtcaggcataattcctcagtttagccttcccacctctatacagtctgatagcagaccagcctttattagtcaaatcagccaagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttaccactttcacttctcagaattcaggtctgtcctcggaatgctacaaggtacagcccatttgagctccttttaattaggccccagtctcattccagacatcagaccaacttggactgtgccccagaaaacttgtcatccctactatcttctgtctagtcatactcctattcaccattctcaactactcatacatgccctgctcttgtttacactgacagtttacactgtttctccaagccagcacagctgatatctcctggtgctatccccaaactgccactcttaactcttgaagtaaataaataatctttgttggcaggactatgctgaatctccttaggcactctctaatcagatgtcctgagttgtcccaattcttagaccttttatacctgtttttctccttctcttattccatttagtttttcaattcatacaaaattgtatccaggccatcaccaataattctaaatgacaaatgtttcttctaacaaccccacaatatcaccccttaccacaaaatcttccttcagcttaatctctcccactctaggttcccacgccgccccaatcccgctaaaagcagccctgagaaacatcgcccattatctctccatagcacccccaaaaaatttttcaccatcccaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaaagaagtgaaaatggcctgtttctgccttaactgatgacattgtcttgtgaaattccttctcctggctcatcctggctcaaaagctcccccactgagtaccttgtgacccccactcctgcccgccagagaacaacccccctttgactgtaattttcctatacctacccaaatcctataaaatggccccacccctatctccccttgctgactctcttttcggactcagcccgcctgcacccaggtgaaataaacagccatgttgctgacaaaaagcctgtttggtggtctcttcacacggacgcgagtgaaa

SEQ ID NO: 108 - DNA, 563 bp, Homo sapiens
ttagagtaggcagttaggcagaactgagcagggcaggagagggcccctatcaggtcgtcaggcaaccatcaggtgatggtcaggcagttgttaaactgtgtcgctaaaatgataattggttgcagctggttccagggacctgcagtctcccagtagatagaaaatacctggagctagtgatcagcagcttcctgataagatctcaggagctaggcgagtcggttcaaacatgtgcactaagaggcaaaatgggagtttaactggtatatgaccttcctctgggaatgcttgactggtaagagaaaaatgcctcaaacgagcatacacacaacttcagtaaacgcactgcacatgcggcccctcccaagtgctggcaggtcactgtgcatgcagacagcctgccccaaggggaaaattaagggaagaaaaacacaaaccccggaaccatgccaatgtataaaaccccaagcccaaggctgaacagggcacttggatctcttatgttgcccacttgaccctcttccaagtgtactttgcttcctttcattcctgctctaaaactt

SEQ ID NO: 109 - DNA, 7137 bp, Homo sapiens
gtcaggcctctgagcccaagccaagccattgcatcccctgtgactgcacatatatgcccagatggcctgaagtaactgaagaatcacaaaagaagtgaatatgccctgccccaccttaactgatgacattccaccacaaaagaagtgtaaatggccggtccttgccttaagtgatgacattaccttgtaaaagtccttttcctggctcatcctggctcaaaaagcacccccactgagtaccttgcgacccccactcctgcccgccagagaacaaaccccctttgactgtaattttcctttacctacccaaatcctaaaaaacggccccacccttatctcccttcgctgactctcttttcggactcagcccacctgcacccaggtgaaataaagagctttattgctcacacaaagcctgtttggtggtctcttcacatggatgcgcatgaaatttggtgccgtgactcggatagggggacctcccttgggagataaatcccccatcctcctgctctctgctccatgagaaagatccatctatgacctcaggtcctcagaccgaccagcccaagaaacatctcatcaatttcaaatccggtaagcgacctctttttactctcttctcctacctccctcactatccctcaagctctttctcctttcaatcttgcaccacacttcaatctctcccttctcttaatttcaattcctttcattttctgatagtgacaaaggagacacgttttatccatggacccggaactctggcgccggtcacggactgggaaggcagccttcccttggtgtttaatcattgcagggacgcctctctgattatacacccatgtttcaagggtgtcagaccacacagggatgcctgccttggtccttcacccttagcggcaagtcccgcttttctggggaaggggcaagtaccccaaccccttctctccttgtctctaccccttctctgcttttccagggacagggcgagtaccccaaccccttctctccttgtctctaccccttctctgcttttccaggaacagggtgagtaccccaaccccttctctccttgtctctaccccttctctgcttttctgggagaggggcaagtaaccatcaaccccttctccttcacccttagcagcaagtcctgcttttctgggggaggggcaagtaccccaacctcatatctctgtgccccaatcccttatttctgcaccccaacctcttatatctctgtgccccaatcccttatttctgcgccccaacctcgtatctctgcactccaatcccttatttccatgccccaacctcgtatctctgtgccccaatcccttatttccatgccccaacctcttatctctgcaccccaaccccttttctggaaggtaagaacccccaaaccccttccctccatttctctactctctcttttctctaggcttgcttccttcactatgggaaacttccaccctccattcctcagtctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaaataattcttgtcgtaaaataggcaaacggtctgaggtgcctgatgtccaggcattcttttacacatcagtcccttcctagtctctgtgcccagtgcaactcgtcccaaatcttccttctttccctcccgcctctcccctcagtaccaaccccaagcgtcgctgagtctttctaatcttccttttctacagacccatctgacctctgccttcctccccaggcttctcctctccaggccgagctaggtcccaattcttcctcagcctctgctcctccaccctataatctttttatcacctcccctcctcacaccttgccggcttacagtttcgttccctgactagccctccccaacctgcccagcaattgactcttaaaaaggtggctggagccaaaggcatagtcaaggttaatgctcctttttctttatcccaaatcagaagcatttaggctcttttttatcaaatataaaaacccagcccagttcatggctcgttcggcagcaaccctgagacactttacagccctagaccctaaaaggtcaaaaggccatcttattctcaatatacactttattacccgatctgctcccgacattaaataaaactccaaaaattggaatctggccctcaaaccccacaacaggatttaattaacctcaccttcaaggtgtacaataacagaaaaaagttgcaattccttgcctccactgtgagacaaaccccagccacgtctccagcacacaagaacttccaaacgcctgaaccgcagcagccaggccttcctccagaacctcctccctcaggagcttgctacacgtgccggaaatctggccactgggccaaggaatgcccacagcccgggattcctcctaagccgcgtcccatctgtgtgggaccccagtgaaaatcggactgttcaactcacctgacagccactcccagagctcctggaactctggcccagggctctctgactgactccttcccagatcttctcggcttagcggctgaagactgacactgcccgatcacctcggaagccccctagaccatcacagactccgagtttccggtaactctcacagtggaaggtaagcccgtccccttcttaatcaatacggaggctacccactccacattaccttcttttcaagggcctgtttcccttgcctctataactgttgtgggtattgacggccagccttctaaacctcttaaaactccccaactctggtgccaacttagacaatactcttttaagcactcctttttagttatccccacctgcccagttcccttattaggctgagacactttaactaaatcatctgctttcctgactattcctggactacagctatatctcattgctgcccttcttcccaatccaaagcctcctttgcatcctcctcttgtatcccccaaccttaacccacaagtataagatacctctactccctccttggcgaccgatcatgcaccccttaccatctcattaaaacctaatcacccttaccccactcagtgccaatatcccatcccgcagcacgctttaaaaagattaaagcctgttatcacttgcctgctacagcatggccttttaaagcctataaactctccttacaattcccccattttacctgtcctaaaaccagacaagccttacaagttagttcaggatctgcgccttatcaaccaaattgttttgcctatccaccccgtgctgccaaacccatatactctcctatcctcaatacctgcctctataacccattattctgttctagatctcaaacatgctttctttactattcctttgcacccttaatcccagcctctcttcactttcagttggactgaccctgacacccatcaagctcagcaaattacctaggctgtactgctgcaaagcttcacagacagcccccattacttcaatcaagcccaaatttcttcctcatctgttacctatcttggcataattctcataaaaacacacgtgctctccctgtcaatcatgtccgactgatctctcaaaccccagcaccttctacaaaacaacaactcctttccttcctaggcatggttagtgcggtcagaattcttacacaagagccaggaccacaccctgtagcctttctgtccaaacaacttgaccttactgttttagcctagccctcatgtctgcgtgcagcggctgccactgcattaatacctttagaggccctcaaaatcacaaactatgctcaactcactctctacagttctcataacttccaaaatctattttcttcctcatacctgacgcatatactttctgcttcctggctccttcagctatactcactcttcgttgagtctcccacaattaccgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcaccacacaccaacaaaggcaggttatgctgtagtacaagccactagcccgcctcttagaacctctcatttcctttccatcatggaaatctatcctcaaggaaataacttctcagtgttccatctgctattctactactcctcagggattattcaggccccctcccttccctacacatcaagctccaggatttgccccacccaggactggcaaattagctttactcaacatgccctgagtcagataactaaaatacctcttagtctaggtagatactttcactggataggtagaggcctttcctacagggtctgagaaggccaccacagtcatttcttcccttctgtcagacataattcctcagtttagccttcccacctcaatacagtctgataacagacgagcctttattagtcaaatcagccaagcagtttttcaggctcttagtattcagggaaacctttatatcccttacggtcctccatcttcaagaaaagtagaatggactaaaggtctcttaaaaacacacctcaccaagctcagccaccaacttaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgtccccaaaaaaacttgtcatccctactatcttctgtctagtcatactcctattcaccgttctcaactactcatacatgccctgctcttgtttacactgccggtttacactgtttttccaaaacatcacagctgatatctcctggtgctatccccagactgccgctcttaactcttgaagtaaataaataatctttgctggcaggactatgctgaatctgcttaagcactctctaatcagatatcctgagtcgtcccaattcttagacattttatacctgtttttctccttttgttattccatttagtttttcaattcatacaaaactgtatccaggccatcaccaatcattctatatgacaaatgattcttctaacatccccacaatatcaccccttaccacaagacctcccttcagcttaatctctcccactctaggttcccacactgcccctaatcccgcttgaagcagccctgagaaacatcgcccattctctctccataccaccccccaaaaattttcgccgccccaacacttcaacactgttttgttttatttttcttattaatataagaaggcaggaatgtcaggcctctgagcccaagccaagccatcgcatcccctgtgacttgcacgtatatgcccagatggcctgaagtaactgaagaatcacaaaagaagtgaatatgccctgccccaccttaactgatgacattccaccacaaaagaagtgtaaatggccagtccgtgccttaagtgatgacattaccttgtgaaagtccttttcctggctcatcctggctcaaaaagcacccccactgagcaccttgcgacccccactcctgcccgccagagaacaaaccccctttgactgtaattttcctttacctacccaaatcctataaaacggccccacccttatctcccttcgctgactctcttttcggactcagcccgcctgcaccaaggtgaaataaacagccatgttgctcaaacaaagcctgtttggtggtctcttcacatggacgtgcatgaaagtcaccacataggggaaaggtggaaagtggaagtgagctcatgagacgagagagaaaatctggctgaactcatctttttttattaggaactcactcccacagtaattaactgactcccaagataaagacatttatccattcccctcatggcctaatcatcccttaaaagcatcacttcttaatattgttacaatagcaattcagcttccaacacatgaattctagggaacatattcacaatatagtagaaccagtcacgtgacaaccatcaataactggaaagaagcaagatagaatggtcttcttattagtttgggaaacaaatgagaactaggtatgagtaagcactagggctttctacagttctccagtggtctgtaagtcaacatattttaaattgttattatgtgtcaacattgaagcccacatacaaaaataaatcaatgtaatacactatattacataaacagataaaacacataatgatttcagtagattcagagaaagaatttgacagaattcaacatagttttatatgattaaaagcactggatgaaacagaaacagaaggcctatgtaagccaatttaaattttattggatatcatccctaatgatgaatgaaacataacatttcatatcacacagttgcgtaataatagaggtaaaaaagtactggcaggacaaaaagattttaatcaagagattttgagagatgcttcagtgatgaaatgaaacaaatttaaaaagagaacaactttggtatataattagaagtcagaaatctaaatatcagatttaatactgtcaggcctctgagcccaagcctgcaggtatacatccagatggccctaagcaagtgaagaatcacaaaagaagtgaaaatggccagttcctgccttaactgatgacattatcttgtgaaattccttctcctggctcagaagctcccccgctgagcaccttgtaacccccacccctgccagcaagagaacaaacccctttgactgtaattttccactacccacccaaatcctataaaacggccccacccctatctcccttcgctgactctcttttcggactcagcctgcctgcagccaggtgattaaaaagctttattgctcacagaaagcctgtttcgtggtcttttcacacggacgcgcatgaaa

SEQ ID NO: 110 - DNA, 478 bp, Homo sapiens
ttacagtagtcagatagtcaggcatgagcagggcaggagagggctccgcctcaccacgaacatcaggcaaccatcaggtaagggtcaggtggttgttacccgtctctctaaaataataattgatcacagctggcaccagcagaaggcaatctccctatagatagaaaaaaaactgaaactggtgatcagcagctttctgataacatctcgggaattgggggagtgagctcaaacatgtgaagtgagaggcagaaagttggagtttaactggtaaatgacctttctaggagcattcggctggtaagggaagaatgcctcaagtgagcatgtgtataacttcagtaaacacactgcacatgctcagcttgcaagtactggcaggccactgcacatgcagacacccaaccccaagagaagaatcaagggagaagggacgcaagaccgcagaagtatgccaacatataaaacatataagtca

SEQ ID NO: 111 - DNA, 377 bp, Homo sapiens
gtcaggtctctgagcccaagcctgcacgtattcattcagatggcctgaagcaagtgaagaatcacaaaagaactgaaaatggccggttcctgccttaactggtgacattaccttgtgaaattccttctcctggctcgtcctggctcaggagctccccgactgagcaccttgtgaccccccacttctgccagccagagaacaaacccctttgactgtaattttccactacctacccaaatcctataaaacggccccaccgctatcttccttcgctgactctctttttggactcagcccgcctgcacccaggtgattaaaaagctttattgctcacataaagcctatttggtggtctcttcacatggacgcgcatggaa

SEQ ID NO: 112 - DNA, 453 bp, Homo sapiens
gtcaggcctctgagcccaagtcaagctatcgcatcccctgtgacttgcacgtatacgcccagatggcctgaaataactgaagaatcacaaaagaagtgaatatgccctggccacaccttaactgatgacattccaccacaaaagaagtgtaaatggctggtccttgccttaactgatgacattaccttgtgaaagtccttttcctggctcatcctggctcaaaaagcacccccactgagcaccttgtgacccccactcctgcccgccagagaacaaaccccctttgactgtaattttcctttacctacccaaatcctataaaacggccccacccttatctccctttgctgactctcttttcggactcagcccgcctgcacccaggtgaaataaacagccatgttgctcacacaaagcctgtttggtggtctcttcacacggacgcccatgaaa

SEQ ID NO: 113 - DNA, 5751 bp, Homo sapiens
gtcaggcctctgagcccaagctaagccatcatatcccctgtgacctgcacatatacatccagatggcctgaaataactgaagaatcacaaaagaagtgatatttaaatggcctgttcctgccttaactgatgacattccaccacaaaagaagtgaaaatggccggtccttgccttaaatgatgacattaccttgtgaaattccttctcctggctcatcctggctcaaaaagctccccgactgagcaccttgtgacccccactcctgcctgccagagaacaaccccctttgactgtaattttcctttagctacccaaatcttataaaacggccccactccatctctcttcactgactctcttttcagactcagcccacctgcacccaggtgattaaaaagctttattgctcacacaaagtctgtttggtggggtctcttcacacagacacaagtgaaattttggtgccatgactcggatcaggggaccttccttgggagatcaatcccctgtcctcctgctctttgctccatgagaaagatctacctacgacctcgggtcctcagaccgaccagcccaaggaacatcacaccaattttaaatccggtaagtggcttctttttactctcttctccaacctctctcactatccctcaacctctttctcctttcaatcttggcgccacacttcaatctctcccttctcttaatttcagttcctttcctttcctcgtagagacaggagacacgttttatccgtggacccaaaactctggcgccggtcacggactcgggaagacagtcttcccttggtgtttaatcatgcggggatgcctgcctgattattcacccacatttcagaggtgtctgaccacatggggacgcctgccttggtccttcacccttaacggcaagtactgcttttctggggggcaagaacctcccaaccccttcttcacccttagcggcaagtaccgcttttctagggggcaagaaccccccaccccttctctccatgtctctactctctcttttctctgggcttgcctccttcactatgggcagccttcacccctccattcctccttctcccttagcctgtgttctcaagaacctcttcaactcacacctgacctaaacctaaacgccttattttcttctacaataccgtttggccccaatacaaactcgacagtggttccaaatagccagaaaacggcacttttgatttttccatcctacaagatctagataattcttatcataaaatgggcaaacggtccgagatgcctgacgtccaggcattcttttacacattgttccctccctagtctgttaccaatgtgacttatcccagatcctccttctttccttcccacctgtcccctcagtcccaaccccaagcattgctgagtctttctaatcttccttttctacagacccatctgacctctctgctcctcaccaggccgagccaggtcccaattcttcctcagcttctgctcccccaccctataatccttttatcacctccactccttccacccagtccagcttacagtttcgttctgtgactagccttcccccaccagcccagcaatttcctcttaaaaaggtggctggagctaaaggcatagtcaaggttaatgctcctttttctttatctgacatctcccaaaatcagttagtgtttaggctctttttcatcaaatatgaaaaacccagcccagttcatggctcatttggcagcaaccctgagacgctttaaagccctagaccctgaaaggtcagaaggccgtcttattctcaatatgcattttattttattacccaatctgttcctgacatgaaataaagctccaaaaattaaattctggccctcaaaccccacaacaggacttaattaacctcacctttaaggtgtacaataatagagtagaggcagccaagtagcaatgtatttctgagttgcaattccttgcctccactgtgagacaagccccagccacatcaccagcatacaagaactccaaacgcctgaaccacagctgccaggggttcctctagaatctcctcccccaggagcttgctacaagtgccagaaatctggccactggaccaaggaatgcccacagcccaggattcctcctaagccatgtctcatctgtgcgggaccccactgaaaatcagactgttcaacttacctggcagccactcccagagcccctggaactctgacccaaggctctctgactgactccttcccagatcctctcggcttagcagctgaagactgacactgcccgattgcctcagaagcctacaggaccatcacagatgctctagataactctcacagtggagggtaagtccatccccttcttaatcaatacagaggctactcactccacattaccttattttcaagggcctgtttcccttgcctccataactgtcgtgggtattgacagccaggcttctaaatctcttaaaactccccaactctggtgccaatttagacaatactcttttaagcactcctttttagttatccccacctgcccagttcccttatcaggccaagacactttaactaaattatctgcttccctgactattcctgggctacagccacacctcattgccaccttttctcccagttcaaagcctccttcacatcctccccttgtatctccccaccttaacccacaagtataagatacctctactctctccttggtgaccgatcatgtacccctaccatctcattacaacctaatcacccttaccctgctcaacgccaatatcccatcccacagcacgctttaaaaggattaaagcctgttatcacttgcctgttacagcatggccttttaaagcctataaactctccttacagttcccccattttacctgtccaaaaacctgacaagccttacaggttagttcaggatctgcaccttatcaaccaaattgttttgcctatccaccccatggtgccaaacccgtatactctcctatcctcaatacctccctccacaacccattattctgttctggatctcaaacatgttttctctactattcctttgcacccttcgtcccagcctctctttgctttcacttggactgaccctgacacccatcaggctcagcaaattacctgggctgtactgccgcaaggcttcacggacagcctccattacttcagtcaagcccaaatttcttcctcatctgttacctatctcggcataattatcataaaaacacacgtgctttccccaccgattgtgtccaactgatctctcaaaccccacaccttctacaaaacaacaactcctttccttcctaggcatggttggatactttcgactttggatacctggttttgccataacaaaaccattatataaactcataaaaggaaacctagctgaccccgtagatcctaaatcctttccccactcctctttccattccttgaagagagctttagagactgcccccaccctagctttccctgactcatcccaacccttttcattacccacagccaaagtgcagggttgtgcagtcggaattcttacacaagaaccgggactacgccctgtaacctttttatccaaacaacttgaccttactgttttgcctagccctcaagtctgtgtgcagtggccaccactgccctaatacttttagaggcccttaaaattacaaactatgctcaactcactctctacagttctcataacttccaaactctattttcttcctcacacctgacacatatactttctgctccccggctccttcagctgtactcactctttgttgagtctcccacaattaccattgttcctggcctggacttcaatccggcctcccacattattcctgataccacacctgagccccatgactatatctctctgatccacctgacattcaccccatttccccatacttccttctttcctgttcctcacccagatcacacttggtttattgatggcagttccaccaggcctaatcgcaacacaccagcaaaggcaggccatgctatagttcaagccactagcctgcctcttagaacctctgatttcctttccatcgtggaaatctattctcaaagaaataacttctcagtcttccatctgctattctactactcctcagagattattcaggccccctcccttccctacacatgaagctcagggatttgcccctgcccaggaccggcaaattagctttactcaacatgccctgagtcaggaaactaaaatacctcttggtcttggtagacactttcactggataggtagaggcctttcccacaggatctgagaaatgacccaccacggtcatttctttccttctgtcagacagaattcctcggtttggccttcccacctctatacagtcctgtaagggaccggcctttattagtcaaatcacccaagcagtttctcaggctcttagtattcagtgaactaatggtcttttaaaaccacaccttaccaagctcagccaccaacttaaaaaggactggacaatacttttaccacttgcccttctcagaattcgggcctgtccttggaatgctacaaggtacagcccatttgagctcctgtatagacgctcctttttattaggccccagtctcattccagacactagaccaacttggactgcaccccccaccaaaaaaaaaaaaaaacttgtcgtccctactatcttctgtctagtcatactcctattcaccattctcaactactcataaatgccctgctcttatttacactgccgatttacactgtttctccaagccaccacagctgatgtctcctggtgctatccccaaaccgccactcttaactccctcttaaagtaaataaatcatctttgccggcagggctatgctgaacttccttaggcactctctagttagatgtcctaggtcctcccaattcttactcctttaatacctgtttttctccttgtcttattccattattttttcaattcccacaaaattgtatccaggccatcaccaataattctataagacaaatgtttcttctaacaaccccacaatatccccccttaccacaaaatcttccttcagcttaatctctcccactctaggttcccacgccacccctaatcctgctcgaagcatccctgagaaacatcgcccattatctctccataccacccccaaaaattttcgccaccccaacacttcaacactattatgttttatttttcttactaatataagaagacaggaatgtcaggcctctgagcccaagctaagccatcatatcccctgtgacctgcacgtatacacctagatggcctgaagtaactgaagaatcacaaaagaagtgatatttaaatggcctgttcctgccttaactgatgacattccaccacaaaagaagtgaaaatggccggtccttgccttaactgatgacattaccttgtgaaattccttctcctggctcatcctggctcaaaaatctcccccactgagcaccctgtgacccccccactcctgcccgccagagaacaactgcctttgactgtaattttcctttacctacccaaatcttataaaatgaccccacccctatctctcttcactgactctcttttcagactcagcccacctgcacccaggtgattaaaaagctttattgctcacacaaagcctgtttggtggtctcttcacacggatgcgagtgaaa

SEQ ID NO: 114 - DNA, 976 bp, Homo sapiens
gtggggaaaagagagatcagattgttactgtgtctgtgtagaaagaagtagacataggagactccattttgttctgtattaagaaaaattcttctgccttgagatgccgttaatctgtaaccttacccccaaccctgtgctccctgaaacatgtgctgtgtcaactcagggttaaatggattaagggctgtgcaagatgtgctttgttaaacaaatgcttgaaggcagcatgctccttaagagtcatcaccactccctaatctcaaaccactccctaatctcaagtacccagagacgcaaaatactgcaaaggccgcagggacctctgcctaggaaagccaggtattgtccaaggtttctccccatgtgatagtctgaaatatggcctcgtgggaagggaaagacctgaccatcccccagcccgacacccataaagggtctgtgctgaggaggattagtaaaagaggaaggaacacctctttgcagttgagataagaggaaggcttctgtctcctgctcgtctctgggcaatggaatgtctgggtgtaaagccgatttactttacatggaatatacttccatctactgagataggggaaaaccgccttagggctgtaggtatgacatgcgggcagcaatactgctctttaaggcattgagatgtttatgtgtatacatatctaaagcacagcacttaattctttaccttgtttatgatgcagagacctttgttcatgtgtttaccttctgaccttctctccactattatcctattatcctgccatgctcgataatgatcaataaatactaagggaactcagaggccggtgccagtgtggatcctctgtatgctgaatgctggtcccctgggcccacttttctttctctatactttgtctctgtgtctcttttccaagtctctcgttccacctaacgagaaacacccacaggtgtggaggggcaacccaccccttca

SEQ ID NO: 115 - DNA, 302 bp, Homo sapiens
tcaacccctgacctaactggttatttgcataaaaaagcactgtgaagatccctgtcctattctgctctgttctaattacaggcgtatgcaacccccagtcacttacccactgcttgctcaatcgaacacgaccctctcatgtggacccccttagagttgtgagcccttaaaatggacaggattgctcactccaggagctcggctcttgagacaggagtcttgccgatgctcccagccaaataaaccccttccttctttaacttggtgtttgaggggtttcgtctgtggctcttcccgctaca

SEQ ID NO: 116 - DNA, 688 bp, Homo sapiens
ttatagtaggtagctagtcaggcatgagcagggcaggagagggttccacctgaccaggaatgtcaggtgaccatcaggtgatggacaggaggttgttaaatgtttctctaaaatagtaattggtcacagccagtgaaagggaaaggcagtctccatatagatagaaaaaaacctgcaactggtgatcagcagcttcccaataagatctgaagagatgggtgagtgagctcaagcatgcacattaagaggcaaaatggtggagtttaactggtatatgaccttcctctaggaatgctagactggtaagggaagaatgcctcaagtgagtatgggcacaactccagtaagcacactgcacaggctcctctcccaagcgctagcaggccactgcgcatgtgaacagcccaccccaagggaagaatcaggggagaagggacacaagaccctggacgtaccaatgtataaaacctcaagtcaaaaggccaaactgcacaataaccgttcgagtcaccagcttggccctcttccaggtgcgcgttccttccttctgttcctgctctaaaactttttaataaattttcactcctctaaaacttctcggtctccctaccttatgcccctcggccgaattctttcttctgaggaggtaagaattgaggttgctgcagatgcatcagattcgctactg

SEQ ID NO: 117 - DNA, 968 bp, Homo sapiens
gtggggaaaagcaagagagatcagactgttactgtgtctatgcagaaagaagtagacataagagactccattttgttctgtactaagaaaaattcttctgccttgagatgctgttaatctgtaaccctacccccaaccctgtgcagaaacatgtgctgtgtggactcaaggtttaatggatttaaggttatgcaggatgcgctttgctaaacaaatgcttggagtcagcatgcttgttaaaagtcacaaccactccctaatctcaagtacccagggacacaaaacactgtggaaggctgcagggacctctgcctaggaaagccaggtattgtccaaggtttctccccatgtgatagtctgaaatatggcctcgtgggaagggaaagacctgaccatcccccagcccgacacccctaaagggtctgtgctgaggaggattagtaaaagaggaagtcctctttgcagttgagataagaggaaggcatctgtctcctgctgctcgtccctgggcaagggaatgtctcagtgtaaaaccggattgtatattccatctactgagataggagaaaaccgccttagggctggaggtgagacatgctggcagcaatactgctctttaatgcactgagatgtttatatatgtgcacatcaaagcacaacacctttttcttaaccttgtttatgacgcagagacatttgttcacatgttttagctgctgaccctctccccactactaccctattgtcctgccacatccacttctctgagatggtagagataatgatcaataaatactgagggaactcagagactggtgctggcgcaggtcctctgtatgctgagcgcctgtcccctgggctcatttttctttctctatactttttctctgtgtctctttcttatgtcagtctcttgtcccacccgacgagaaacacccacaggtgtggaggggcaggccaccccttca

SEQ ID NO: 118 - DNA, 400 bp, Homo sapiens
gtcaggcctctgagcccaagctaagccatcatatcccctgtgacctgcacatacacatccagatggctggttcctgccttaactgatgatattccaccacaaaagaagtgaaaatggccggttcctgccttaactgatgacactaccttgtgaaattccttctcctggctcatcctggctcaaaacgtcccccgctgagcaccttgtgatcctcacccctgcccaccagagaacaacccccctttttcctttacctacccaaatcttataaaacggccccactcctatctcccttcgctgattctcttttcggactcagcccacctgaaacccaggtgaaatagccttgttgctcacacaaagcctgtttggtggtctcttcacatggatgtgagtgaaa

SEQ ID NO: 119 - DNA, 1225 bp, Homo sapiens
atggtaaatatgtatacagactctaagtatgcttatctagtcctccatgcccactcagcaatatggagagaaaggaaattcctaacttccaagggaacacctatcaaatatcaggaagccattaggagattattattggctgtacagaaacctaaagagttggcagttttacactgctggggtcatcagaaaggaaaggaaagggaaatagaagggaaccgccaagcggatattgaagtaaaaagagccgcaaggcaggaccctccattagaaatgcttatagaaggacccctagtatgtggtaatcccttctgggaaaccaagccccagtactcagcaggaaaaatagaatagggaacctcacgaggacatagtttccttcgctcaggatggctagccaccgaagaagggaaaatacttttgcctgcagctaaccaatggaaattacttaaaacccttctccaagcctttcacttaggcattgatagcacccatcagagggccaaatcattatttacaagaccaggccttttcaaaactatcaagcagatagtcagggcctgtgaagtgtgccaaagaaataatcccctgcgctgcaggccatacatttcaatccctgtatctttaacctccttgttaagtttgtctcttccagaatcgaagctgtaaaactacaaatagttcttcaaatggagccccagatgtagtccatgactaagatctaccacagacccctagaccagcctgctagcctgtgctctgatgttaatgacatcgaaagcacccctcctgaggaaatctcaactgcacaacccctactatgccccagttcagcaggaagcagttagagcggtagtcggccaacctccccaactgcacttgagtttttcctgttgagagcggggactgagagacaagactagctggatttcctaggccgactaaaaatccctaagcctagctgggaaggtgaccgtgtccacctttaaacacggggcttgcaacttagctcacacccaaaccaatcagagagctcactaaaatgctaattagacaaaaacaggaggtaaagaaatagccaatcatctatcacctgagagcacagcaggagggacaatgaccgggatataaacccaagcatttgagccagcaatggcaaacccctttgggtctcctgcctttgtatgggagctctgttttcactctattaaatcttgcaactgca

SEQ ID NO: 120 - DNA, 3522 bp, Homo sapiens
tgatctgatgtggaaagatataatgttactgctagatcagacactaaccccaaatgagagaagtgccaccataactgcagcctgagagtttggcgacctccagtatctcagtcaggtcaatgataggatgacaatagaggaaaaagcaactaagtcaaaaagcgaaaagggagcttactaactcaaaaatcttaaagtatggggctattctgttagaaaaaggtgatttaacactaaccactgaaaattcccttaacccagcagatttcctaacaggggatttaaatcttaattaccatacaaaggtccgaccagacctaagagtaactctcttccggacaggacggactgatggctcctcccaagcgattgaggagaaaaaaacacaatgggtattcagtaattgatagggaaactctcgtagaagcagagttagaaaatttgcctaataattggtctgctcaaacgtgcggagctgtttgcactcagccaagccttaaagtacttatagaatcaaaaatctctatctcaatcctgactcaaaaggttacctacaacgtctctgaaatgaatttgcataagaactgttgtttatgggaatgcatcttgatggggcagctgggttgttatgaaatactcaggaacccagcccagctctaggactcacccctgagcacaaaggcaatgttgggcacgctggtaaaggatcactagaatccagcagcctggacctttctttgtggtcaagaaaggcaggaaaacaggtgcaagacttctacatcggtaagcgtaactaatccgataagcagaggtccatgggttgttatgcatcctggaaaggaataagcattaggaccatagaggacgctctaggactaaagcgcatcagaaaatgactaggggtgctggcatccctatgttcttttttcagatgggaaacattccccccaaggcaaaaacgcccctaagatgtattctggagagttcagcccagtcagagtgcgtgcacctttttctctctcagacttaaagcaaattaaaatagacttaggtaaattctcagataaccttgagaattaagttaggacaatcctttgatctgacatggagagatataatgtcactgctagatcagacactaacctcaaatgggagaagtgccgccataactgcagcctgagagtttggcgatctctggtgtctcagtcaggtcaatgataggatgacaacggaggaaaaagaacaattccccacagcccagcaggcagttcccagtgtagacactcattgagacacagaatcagaacacagagattggtgccgcagacatttgctaacttgtgtgctaaaaggacaggaaaactaggaagaagcctataaattattcaatgatgtccactataacacagggaaaggaagaaaatcctactgcctttctggagagactaagggaggcgttgaggaaacatagctctctgtcacctgactctattgaaggccaactaatcttaaaggataagtttatcactcagtcagctgcagatattaggaaaaaaaacttcaaaagtctgccttaggcccggagcaaaacttagaaaccctattgaactgggcaacctcggttttttataatagagatcaggaggagcaggtggaacgggacaaacgggattaaaaaaaggccaccgctttagtcatggccctcaggcaagcagactttggaggctctggaaacgggaaaagctgggcaaatcgaatgcctaatagggcttgcttccagtgtggtctacgaggacactttaaaaaagattgtccaagtagaaataagccgccccctcgtccatgccccttatgtcaagggaatcactggaaggcccactgccccaggggacgaaggtcctctgagtcagaagccactaaccagatgatccagcagcaggactgagggtgcccagggcaagtgccagcccatgccatcaccctcacagagccctgggtatgcttgaccattgagggccaggaggttaactgtctcctggacactggcggccttctcagtcttactctcctgtcccagacaactgtcctccagatctgtcactatccgaggagtcctaggacagccagtcactagatacttctcacagccactaagttgtgactggggaattttactcttttcatatgcctttctaattatgcctgaaagccccactcctttgatagggagagatatcctagcaaaagcaggggctatcatacactagaattaggagaaggaaaaagggtaaatatatatacagactctaagtatgcttacctagtcctccatgcccacgcagcaatatggacagaaaaggaattcctaacttccgagggagcacctatcaaatatccggaagccattaggagattattattggctgtacagaaacctaaagaggtggcagtcttacactgctggggtcatcagaaaggaaaggaaaggaaagggaaatagaagggaaccgccaaatggatattgaagccaaaagagccacaaggcgggaccctccattagaaatgcttatagaaggacccctagtgtggggtaaccccctccaggaaaccaagccccagtactcagcagaagaaatagaatggggaacctcacgaggacatagttttctcccctcaggatggctagccaccaaagaaggaaaaatacttttgcctgcagctaaccaatggaaattacttaaaatccttcaccaaacctttcactctggcattggtagcacccatcagatggccaaattattatttactggaccaggccttttcaaaactatcaagcagatagtcagggcctgtgaagtgtgccaaagaaataatcccctgcacttcaggccatacatttcaatccctgtatctttaacctccttgttaggtttgtctcttccagaatcgaagctgtaaactacaaatggttcttcaaatggagccccagatgcagcccatgactaagatctactggggtcccctggactggcctgctagcccatgctccgatgttgatgacatcgaaggcaaccctccagaggaaatctcaactgcacaacccctacttcaccccaattcagcagtaagcagttagagtgatcgtcggccaacctccgcaacagcacttgggttttcctgttgagagggggaactgaaagacaggactagctggatttcctaggccaactaataattcctaagcccagctgcgaaaggtgactgcacctacctttaaacacggggctagtaactcagctcacacccaactaatcaggtagtaaagagggctcactaaaataaaaattaggctaaagcaggaggtaaagaaatagtcaaatcatatattgcctgagagcacagagggagggacaatgatccggatataaacccaggcattcaagcagggagtggcaaccccctttgagtcccctcccattatatgggagctctgttttcactctgttaaatcttgcaactaca

SEQ ID NO: 121 - DNA, 132 bp, Homo sapiens
tgccaacgtataaaaccccaagtcaaaccacacacttgactctctcaagtcacccacttagtcctcttccaagtgtattttacttcctttcattcctgctctaaagcttttaaataaatattcactcctgct

SEQ ID NO: 122 - DNA, 432 bp, Homo sapiens
gtcacgcctctgagcccaagccaagccatcgcatcccctgtgacttgcacatatatgcccagatggcctgaagtaactgaagaatcacaaaagaagtgaaaaggccctgccctgccttaactgatgacattccaccattgtgatttgttcctgccccaccttaactgagtgattaaccctgcgaatttccttgtcctggctcagaagctcccccactgagcaccttgtgacccccgcccatgcccaccagtgaacaaccccctttgactgtaattttccattaccttcccaaatcctataaaacggccccaccccatctccctttgctgactctcttttcagactcagcccgcctgcacccaggtgaaataaacagccatgttgctcacacaaagcctgtttggtgatctcttcacacggacgtgcatgaaa

SEQ ID NO: 123 - DNA, 497 bp, Homo sapiens
gttatgaggtcaccacttctcctgttgtccttctcagtttctccccaacctccccttttccctagtttataagacaggagaaaagggagaaagcaaaaagttggaaagaaacagaagtaagataaatagctagacgactttggcgccaccacctgaccctggtggctaaaataataataatattattaacccctgaccaaaactactggtgttatctgtaagttccagacattgaatgagaaagcactgtaaaactttttgttctgttagctgatgtatgtagcccccagtcacgtttctcatgcttacttgatctattatgactttttcaggtagaccccttagagttgtaagcccttaaaagggctaggaatttctttttcagggagctcggctcttaagacacgagtctgccgatgctcccagctgaataaaaaaacctcttccttctttaatctggtgtctgaggagttttgtctgctactcctcctgctaca

SEQ ID NO: 124 - DNA, 4335 bp, Homo sapiens
gtcaggtctctgagcccaagccaagccatcccatcccctgtgacttgcacgtatacgccgagatggcctgaagtaactgaagaatcacaaaagaagtgaaaggccctgccccgccttaactgatgacattccaccattgtgatttgttcctgccccaccttaactgagtgactaaccctttgaatttccttctcctggctcagaagctcccccaccgagcaccttgtgacccccgcccctgcccaccagagaacaaccccctttgactgtaattttcctttaccttcccaaatcctataaaacggccccacccttatctcccttcactgactctcttttcggactcagcccaaccgcatccaggtgaaataaacagctttattgctcacacaaagcctgtttggtggtctcttcacatggacacacatgaaatttggtgccgtgacttggatcgggggacctcccttgggagatcaatcccccgtcctcctgctctttgctccgtgagaaagatccatctacgacctcaggtcctcagaccgaccagcccaagaaacatctcaccaatttcaaatccggtaagcggcctctttttactctcttctccaacttccttcactatccctcaacctctttctcctttcaatcttgacaccacacttcaatctctcccttctcttaatttcaattcctttcattttcggatagagacaaaggagacatgttttatccgtggacccaaaactccggtgccggtcacggactgggaaggcagccttcccttggtgtttaatcattgcagggatgcctctctgattattcacccacatttcaaaggtgtcagaccacgcagggatgcctgccttggtccttcacccttagccgcaagtcccgcttttctgggggaggggcaagtaccccaaccccttctctccatgtctctaccccttctctgcttttctgggggaggggcaagtacccctcaaccccttctccttcacccttagtggcaagtcccgcttttctagggggcaagaacccccaatcccttatttccgtgccccaaccctttctctgcttttctggagggcaagaaacccccatcacttctccgtgtctctactcttttctctgggcttgcctccttcactatggactagcttccaccttccattcctccttcttctcccttagcctgtattcttaagaacttaaaacctcttcaactctcacctgacctaaaatctaagcgtcttttttcttctgcaatgccgcttgaccccagtacaaactcgacagtagttacaaattgccagaaaaacggcactttcaatttttccatcctacaagacctaaataattcttgtcgtaaaacgggcaaatggtctgaggtgcctgatgtccaggcattcttttacacatcagtcccttcctagtctctgcccaatgcaattcatcccaaatcttccttctttccctcccgcctgtcccctcaggcccaaccccaagcgtcgctgagtctttctaatcttccttttctacagacccatctgacctctcccctcctcgccaggccgagctagttcccaattcttcctcagcctctgctcctccaccctataaactttttatcgcctcccctcctcacacctgatccggcttacagttttgttccatgactacccctcccccacctgcccagcaatttactcttaaaaaggtggctggagccaaaggcatagtcaaggttaatgctcctttttctttatcccaaatcagaagcgtttaggctctttttcatcaaatataaaaacccagcccagttcatggctcattcggcagcaaccctgagatgctttacagccctagaccctaaaaggtcaaaaggccatcttattctcaatatacattttattacccaatctgctcctgacattaaataaaactccaaaaattggaatctggccctcaaaccccataacaggacttaattaacctcactttcaaggtgtacagtaataaaacaaagttgcaattccttgcctccactgtgagacaaaccccagccacatctccagcacacaagaacttccaaacgcctgaacctcagtggccaggcattcctccagaacctcctcccccaggagcttgctacaagtgccagaaatctgaccaccaggccaagtaatgcccgcagcccaggattcctcctaagccgtgtcccatctgtgtgggaccccagtggaaatcggactgttcaactcacctggcagccactcccagagcccctggaactctggcccaaggctctctgactgactccttcttggcgtagcggctgaagactgatgctgcctgatcacctcagaagccccatagaccatcacggacgccgagctttaggtaactctcacagtggagggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaatactcttttatgcactcttttttagttatccccacctgcccagttcccttattaggccgagatattttaaccaaattatctgcttccctgactattcctggactacagccgcatctcattgctgcccttcttcccaatccaaagcctcctttgcatcctcttcttgtattcccccaccttaacccacaagtataagatacctctactccctccttggtgaccgatcatgcaccccttatcatctcattaaaacctaatcacccttaccccgctcagtgccaatatcccattacagcatgctttgaaaggattaaagcctgttatcactcgcctgctacagcatggccttttaaagcctataaactctccttacaattcccccattttacctgtcctaaaaccagacaagccttacaagttagctcaggatctatgccttatcaaccaaattattttgcctatccacctcatggtaccaaacccatatactctactatcctcaatacctccctccacaatccattattctgttctggatctcaaacatgctttctttactattcttttgcaccagtcatccaagcctctcttcgctttcacttggactgaccctgacacccatcaggctcagcaaattacctgggctgcactgccacaaggcttcacagacagaccccattacttcagtcaagcgcaaatttcatcctcatctgttacctatctcggcataattctcgtaaaaacacacatgctctccctgatgatcgtgtccgattaatctcccaaacctcaatcccttacaaaacaacaactcctttccttcctaggcatggttaatgtggtcagaattcttacacaagagccaggaccgcaccctgtagcctttctgtccaaacaacttgaccttactgttttagcctagccctcatgtccgcgtgcagcggctgccgctgctttagtacttttagaggccctcaaaatcacaaactatgctcaactcactctctacatttctcataacttccaaaatctattttcttcctcatacctgacgcatatactttctgctccctggctccttcagctgtactcactctttgttaagtcccacaattaccattgttcctggcccggacttcaatccagcctcccacattattccagacaccacacctgaccctcatgactgcatctctctgatccacctgatgttcatcccatttccccacatttccttcgtccctgtttctcaccctgatcacgcttgatttattgatggcagttccaccaggcctaatcaccacacaccagcaaaggcaggctatgctatagtacaagccactagcccgcctcttagaacctttcatttcctttccatcgtagaaatctatcctcaaggaaataacttcttagtgttccatctgctattccatctgctactcctcaaggattattcaggccccttccctacacaacaagctcgaggatttgcccccacccaggactggcaaattagctttactcaacataccccgagtcccaaaaactaaaatacctctttgtctaagtagacactttcactagataggtagaggcctttcctatagggtctgagaaggccactgcagtcatttcttcccttctgtcagacataattcctcagtttagccttcccacctctatacagtctgataaaagaccagcccttattagtcaaatcagtcaagcatttttttaggctcttagtatccagtg

SEQ ID NO: 125 - DNA, 3487 bp, Homo sapiens
gtcaggcctctgagcccaagctaagccatcatgtcccctgtgacctgcatgtacacatccagatggccagttcctgccttaactgatgacattatcttgtgaaattccttctccttgctcatcctggctcaaaaagctcccctactgagcaccttgtgaccccaacccttcctgccagagaacaaccccctctttcctttacctacccaaatcctataaaatcgccccaccccatctccctttgctgactctctttttggactcagcccacctgaacccaggtgaaataaacagctttattgctcacacaaagcctgtttggtcgtctcttcacacggatgcatgtgaaatttggtgctgtgactcggactgggggacctcccttgggagatcaatcccctgtcctcctgctctttgctctgtgagaaagatccacctatgacctcaggtcctcagactgaccagcccaagatacatctcaccaatttcaaatctgggaagcagcttctttttactctcttctccaacctcccttactatccctcaacctctttctcctttcaatcttggcaccacacttcaatctctcccttctcttaatttcaattcctttcattttctggtagagaccaagtagacacgttttatccatggacccaaaactccggtgccggtcacagactagggaaggcagccttcccttggtgtttaatcattgcagggacgcctctctgattattcacccaggtttcagaggtgtcagaccacgcagggctgcctgccttggtccttcacccttagcagcaagtcccgcttttctgagggaggcccaggaaccccgacctgttatctctgtgccctgatcccttatttccatgccccaccctcttacctctgtgccctgatcccttatttccacaacctgacctcctatctctgcaccccaaccctttatttctgtgccccaacccgtttcccacttttctggaaggcaagaatgccccaccccttctcttcatgtctctattctctcttttctctgggcttgcctccttcactatgggcaagcttccgccctccattcccctttcttctcccttagcctgtgttcttaaaaacctaaaacctcttcaactcacacctgacctaaaacctaaatgccttattttcttccacaatgccacttgaccccaatacaaactcgacagtggttccaaatagccagaaaatgacactttcaatttttccatcctacaagatctagataattcttgtcataaaatgggcaaattgtctgaggtgactgatgtccaggcattcttttacacatcggtccctccctagtctgttcccagtgcaactcatcccaaatcttccttctttccatcccacctgtcccctcagtcccaaccccaagcatcgctgactctttctaatcttccttttctacagacccatctgacctctcccctcctcgccaggctgagctaggcctgaattcttcctcagcctctgctcttccaccctataatccttttatcacctcccctcctcacactgggtccggctgacagtttcgttccatgacaagccctccccaacctgcccagcaatttcctcttaaaaaggtggctggagctaaaggcatagtcaaagttaatgctcctttttctttatcccaaatcagataaggtttaggctctttttcatcaaatataaaaataaaccccagttcatggctcgtttggcagcaaccctgagatgttttagagccctagaccctaaaaggtcaaaagaccgtcttattcttaatatacattttattacccaatctgctcccgacgttaaataaaactccaaaaattaaattcctgccctcaaaccccacaacaggacttcattaacctcgccttcaaggtgtacaataatagagtagaggcagccaagtagcaacatatttctcagttgcaattccttgcctccactgtgagacaaaccccagccacatctccagcacacaagagcttccaaacgcctaaagcgcagtggccaggcattcctccagaaccgcctcccccaggagcttgctacaagtgccggaaatctggccaccaggccaaggaatgcctgcagtccgggattcctcctaagccatgtcccatctgtacgggaccccactagaaatcggactgttcaactcacctggcagccactcccagagcccctgggactccagcccaaggctccctgactgactccttcccagatcttcttggcttagcagctgcagaccgacactgcctgatcgatcgcctcggaagcctacaggaccatcacagacgctctaggttactctcacagtggagcgtaagtctatccccttcttaatcaatacggaggctacccactccacattaccttcttttcaagggcctgtttcccttgtctccataaccgttgtgggtattgacagccaggcttctaaacctcttaaaactccccaactctggtgcaacttagacaatactcttttaagcactcctttttagttatccccacctgcccagttcccttattaagacgagacacttcaactaaactatctgcttccctgactattcccggactacagatacatctcattgccacccaccgtaacccacaagtagaagatacctctactccctccttggcgacctatcatgcaccccttaccatctcattaaaatctaatcacccttaccccgctcaatgccaatatctcatcccacagcatgctttgaaaggattaaagcctgttatcacttacctgctacagcatggccttttaaagtctataaactctccttacaattcccccatcttacctgtcctaaaaccagacaagccttacaagttagttcaggatctatgacttatcaaccaaattgttttgcctatccaccccaaggtgccaaacacatatactctcctatcctcaactcctccctccacaaccccttattctgttctggatctcaaacatgctttctttactattcctttgcacccttcatcccagccactcttcgctttcacttggactgaccctgacacccatcaggctcagcaaattacctgggctgtactgccgcaaagcttcacagacagcccccattacttcagtcaagcccaaatttcttccttatgtgttacctatctcagcataattctcataaaaccacacgtgctctccctgccgatcgtgtgtgactaatctctcaaaccccaaccccttctacaaaacaacaactcctttccttcccgggcatggttggatactttcatctttagatacctggttttgccatcctaacaaaaccattatataaactcacaaaaggaaacctagctgaccccatagatcctaaatcctttccccactcctctttctgttccttgaagacagctttaaagactgcccccaccctagtcttggttccctgac

SEQ ID NO: 126 - DNA, 356 bp, Homo sapiens
gttaggcctctgagcccaagctaagccatcatatcccctgtgacctgcatgtacacgtccagatgcccagttcctgtcttaactgatgacattaccttgtgaaattccttctcctggctcatcctggctcaaaagctccccaactgagcaccttgtgacccccacccctgcctgccagagaaccccctttgactgtaattttcgtttacctacccaaatcttataaaacagcctcacccctatctcccttcgcagactctttttggacttagcccgcctgcacccaggtgaaataaacagccttgttgctcacacaaagcctgtttggtggtctctttacatggacacgagtgaaa

SEQ ID NO: 127 - DNA, 972 bp, Homo sapiens
gtggggaaaagaaagagagatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagagacacactacactgcggaagactgcagggacctctgcctaggaaagccaggtattgtccaaggtttctccccatgtcatagtctgaaatacagcctcatgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatattccatctactgagataggagaaaaccgccttaggactggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctccggaaacgcccaataatgatcaataaatactaagggaactcagaggccagtgcaggcatgggtcctccgtatgctgaacgccagtcccctgggcccatttttctttctctgtactttgtctctgtgtctctttcttttccaagtctctccttccacctaacgagaaacgcccacaggtgtggaggggcaacccatcccttca

SEQ ID NO: 128 - DNA, 972 bp, Homo sapiens
gtggggaaaagaaagagagatcagattgttactgtgtctgtgtaggaagaagtagacataagagactccattttgttcggtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagccagacacccgtaaagggtctgtgctgaggaggattagtaaaagaggaaggaaggcctctttgcagttgagataagaggaaggcatctgtctcctgctcgtccctgggcaatggaatgtctcggtgtaaagcccgattgtatattccatttactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttaacgtgtttacctgctgatcttctctccactattatcctattgtcctgccacatccccctctctggaaatgcccgataatgatcaataaatactaagggaactcagaggccagtgccagcatgggtcctccgtatgctgaacgccggtcccctgggcccatttttctttctctgtactttgtctctgtgtctctttcttttccaagtctctccttccacctaatgagaaacgcccacaggtgtggaggggcaacccatcccttca

SEQ ID NO: 129 - DNA, 58 bp, Homo sapiens
tgcctgtatatgccggcagccccctagcccgctctttcactggatatctgtgtctgag

SEQ ID NO: 130 - DNA, 968 bp, Homo sapiens
gtggggaaaagaaagagagatcagactgttattgtgtctatgtagaaagaagtagacataagagactccattttgttctgtactaagaaaaattcttttgccttgagatgctgttaatctgtaaccctacccccaaccctgagctcccagaaacatgtgctctgtcaactcaaggtttaatggattaagggctatgcaggatgtgctttgttaaacaaatgcttgaaggcagcattcttgttaaaagtcatcaccactccctactctcttgtacccagggacacaaaacactgcagaaggccgcagggacctctgcctaggaaagctaggtattgtccaaggtttctccccatgtgatagtctgaaatatggcctcatgggaagggaaagacctgaccgccccccagcccaacacccataaagggtcggtgctgaggaggattagtaaaagaggaaggcctctttgcagttgagataagaggaaggcatctatctcctgctcgtccctggggcaatggaatgtgttgatgtaaaacctgattgtatattccatctactgagataggagaaaaccaccttagggttggaggtgagacatactggaagcaatactgctctttaaggcgttgagatgtttatgtatatgcacatcaaaagcgcagcacttttttctttaccttgtttatgatgcagagacatttgttcacatgttttcctgctgaccttctctccactattaccctattgtcctgccacatccccctctgcgagaaacgccagataatgatcaataaatactaagggaactcagagactggggccggcgctggtcctccgtatgctgagcaccggtcccctgggcccacttttctttctctatactttgtctctgtgtctctttcttttctcaagtctctcattccacctgacgagaaatgcccacaggtgtggaggggcagcccacccct

SEQ ID NO: 131 - DNA, 5645 bp, Homo sapiens
gtccagcctctgagcccaagctaaaccatcatatcccctgtgacctgcacatacacatccagatgggcgattcctgccttaactgatgacattccaccacaaaagaagtgaaaatggcctgttcctgccttaactgatgacattaccttgtgaaattccttctcttggctcatcctggcttaaagctcccccgctgagcaccttgtgaccccccccccaacccctgcccgccacagaacaaaccccctttgactgtaattttcctttatctacccaaatcttataaaatggccccacccctatctcccttcgctggctctcttttcggactcagcccacctgcccccaggtgaaataaacagccttgttgctcgcacaaagcctgtttcgtggtctcttcacatggatgcgagtgaaattttggtgccgtgactcggatcgggggacctcccttgggagatcaatcccccgtcctgctctttgctccgtgagaaagatccacctacgacctctggtcctcagaccgaccaggccagggaacatctcaccaattttaaatcaggtaagcgacctctttttactctcttctccaacctctcactatccatcaacctctttctcctttcaatcttggcaccatctttcaatctctcccttctcttaatttcagttccttcccttttctggtagagacaactcaggagatgcattttatccatgaacccaaaactccggcgccagtcacagactcgggaaggcagccttcccttggtgtttaatcacgtggggatacctgcctgattattcacacacatttcaggtgtgtctgaccacgcggggacgcctgccttggtccttcacccttagcggcaaatgccgcttttctgggggacaagaaccccctgaccccttctctccgtgtctctactctctcttttctctggacttgcctccttcactatgggcaaccttccaccctccattcctccctctactcccttagcctgtgttctcaagaacttaaaacctcttcaactcacacctgacctaaaacctaaatgccttattttcttctacaatgcaatctgaccacaatacaaactcgacagtggttccaaatagccagaaaaaggcgctttcgatttttccatcctacaagatctaaataattcttgtcataaaatgggcaaacggtctgaggtgcctgacatccaggcattcttttacacatcagtgcctccctagtctctgttcccaatgcgactagtcccaaatcctccttctttccctcccgcctgtcctctcagtcccaaccctaagggtcgctgagtatttgtaatcttccttttctacagacccatctgacttctcccctcctccccaggctgctcctcgccaggccaagccaggtcccaattcttcctcagcctctgctcccccaccctgtaacccttttatcacctcccctcctcacacccggtccagcttacagtttcgttcagcaactagccctccccgacctgtccagcaatttcctcttaaaaaaggtggctggagctaaaggcatagtcgaggttaatgctcctttttctttatccgacctctcccaaaatcagttagcatttaggctctttttcatcaaatatgaaaaacccagcccagttcatggctcattcggcagcaaccctgagatgctttatagccctagaccctaaaaggtcaaaaggccatcttattctcaatatacattttattaccaaatccgctcctgacattaaataaaactccaaaaattaaattccggccctcaaaccccacaaacaagacataattaacctcgccttcaaggtgtacaataatagagtagaggaagccaagtagcaatatatttctgagttgcaattccttgcctccactgtgaaagaaaccccagccacatctccacacacaagaacttccaaacgcctgaactgcagctgccaaggtttactccggaaatctggccactgggccaaggaatgcccacagcccgagattccccctaagccgtgtcctgtctgtgcgggaccccactgaaaatcggactcttcaactcacctggcagccgcttccagatcccctggaactctggcccaaggctctctgagtgactccttcccagatcttctcggcttagcagctgaagactgacactgcccaatcgccttggaagcctacaggacaatcacagatgctctgggtaactctcacagtggagggtaagtccatccccttcttaatcaatacggaggctacccactccacattacttcttttcaagggcctgtttcccttgcctccataactgttgtgggtattgacggccaggcttctaaacctcttaaaactccccaactctggtgcccacttagacaacattcttttatacactcttttttaagttatccccacctgcccagttcccttattaggccaagacattttaactaaattatctgtttccctgactattcctggactacagcaacacctcattgccacccttttccccatttcaaagcctccttcacatcctcctctcgtatccccccaccttaacccacaagtataggacacctctactccctccttggtgactggtcatgcaccccttaccatcccattaaaacctaatcacccttacccccctcaatgccaatatcccatcccacagcatgctttaaaaggattaaagcctgttatcacttgcctgttacagcatggccttttaaagcctataaactctccttacaattcccccattttacctgtcctaaaaccagacaaggcttacaggttagttcaggatctgcgccttatcaaccaaattgttttgcctatccaccctgtggtgccaaacccatatactctcctagcctcaatgcccccctccacaacccattattctgtctggatttcaaacatgctttctttactattcctttgcacccttcatcccagcctctcttcgctttcacttggactgaccctgacacccatcaggctcagcaaattacctgggctgtgctgccgcaaggcttcacagacggcccccattacttcaatcaagcccaaatttctttcaatcaagcccaaatttcttcctcatctgttacttatctcggcgtaattctcataaaaacacacatgctctccctgccgattgtgtccaactgatctctcaaaccccaacaccttctacaaaacaataactcctttccttcctaggcatggttagatactttcgactttagacacctggttttgccatcctaacaaaaccattatataaactcacaaaaagaaacctatctgaccccatagatcctaaatcctttccccactcctctttccgttccttgaagacagctttagagacttcccccaccctaactctccctgactcatcagaacccttttcattacccacagctgaagtgcaggactgtgcagtcagaattcttacacaagaactgggaccacaccctgtagcctttttatcccaacaacttgaccttactgttttgcctagccctcaagtctgcgtgcggcagctgccgctgccctaatacttttagaggcccttaaaatcacgaactatgatcaacagttctcataacttccaaaatctattttcttcctcacacctgacacatatactgtctgctccctggcttcttcagctgtactcactctttgttgagtctcccacaatcaccactgttcctggcccggacttcaatccagcctcccacattattccagataccacacctgacccccacgactgtatctctctgatccacctgacattcaccccatttccccatatttccttctttcttgttcctcaccctgatcacacttagtttattgatggcagttcccaccaggcctaatcgccacacaccagcaaaggcaggctatgctatagtacaagccactaccccgcctcttagaacctctcatttcatttccatcgtggaaatctatcctcaaggaaataacttctcagtgttccatctgctattctactactcctcagggattattctggccccctcccttccctacacatgaagctcggagatttgcccccacccaggactggcaaattagctttactcaacatgccccaagtcaggaaactaaaatacctcttggcctgggtagacattttcactggataggtagaggactttcccacagggtctaagaaggccaccatggtcatttcttcccttctgtcagacataattcctcagtttgggcttcccacctcttcacagtctgataacagaccagcgtttattagtcaaatcagccaagcattttttcagactcttggtattcagtgaaacctttacatcccttaccatcctcaatcttcaggaaaggtagaatggactaatggtcctttagaaacacacctcaccaatctcagccaccaacttaaaaaggactgtacaatacttttaccacttgcccttctcagaattcaggcctgtcctcggaatgctacaggttatagcccatttaagctcctgtatggatgctcctttttattaggccccagtctcattccagataccagaccaacttggactgtgccccaaaaaacttgtcatccctactatcttctctctagtcatactcctattcactgttctcaactactcctgcatgccctgctcttgtttacactgccggtttacactgtttctccaagccatcacagctgatatctcctggtgctatccccaaactgccactcttaactcttaacgtaaataaataatctttgctggcaaggctatgctgaacctccttaggcactctctaattagatgtcctgggtcctcccaattcttagtcctttaatacctgtttttctccttctcttattccatttagttttcaattcatacaaaaccatatccaggccatcaccaataattctacacaacaaatgtttcttctaacaaccccacaatatcaccccttaccacaaaatcttccttcagcttaatctctcccactccaggttcccatgccgccccaatcccgctcgaagcagtcctgagaaacatcacccattatctctccataccacccccaaaaattttcgccgccccaacactttacaactatttcggttttttttttttcttattaatataagaagacaggaatgtcaggcctctgagcccaagctaagccatcatatcccctgtgacctgcacatacacatccagatggccagttcctgccttaactgatgagattccaccacaagagaagtgaaaatggcctgttcctgccttaactgatgacattaccttgtgaaattccttctcctggctcacctggctcaaaagctcccccgccaagcaccttgtgacccccacccctgaccaccagagaacaacccccctttgactgtaattttcctttacctacccaaatcttataaaatggccccacccctatctcccttcgctgactctcttttttggactcagcccacctgcacctggctgaaataaacagccttgttgctcacacaaagcctgtttggtgttctcttcacagggacgtgagtaaaa

SEQ ID NO: 132 - DNA, 397 bp, Homo sapiens
gtcaggcctctgagcccaagctaagccatcatatcccgtgacctgcaggtatacatccagatggcctgaagtaactgaagaatcacaaaagaagtgaaaatggcctattcctgccttaactgatgacattatcttgtgaaattccttctcctggctcatcctggctcaaaagctcccccactgagcaccttgtgacccccacccctaccagctagagaacaaccccctttgactgaattttcctttacctacccaaatcctataaaagggccccatccctgtctccctttgctgactctctttttggactcagcccgcctgcacccaggtgaaatgaacagccttgttgctcacacaaagcctgtttggtggtctcttcacatggatgcaagtgaaa

SEQ ID NO: 133 - DNA, 6501 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccctgtgctctctgaaacatgtgctctgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaagaaggcatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgaaatgtttatgtgtatgcatatctaaaagcacagcacttaatcctttaccttgtctatgatgcaaagacctttgttcacgtgtttgtctgctgaccctctccccacaattgtcttgtgaccctgacacatccccctcttcgagaaacacccacagatgatcaataaatactaagggaactcagaggctggcgggatcctccatatgctgaacgctggttccccgggtccccttctttctttctctatactttgtctctgtgtctttttcttttccaaatctctcgttccaccttacgagaaacacccacaggtgtgtaggggcaacccacccctacatctggcgcccaacgtggggcttttctctagggtgaaggtacgctcgagcgtggtcattgaggacaagtcgacgagagatcccgagtacttctacagtcagccttacggtaagcttgtgcactcggaagaagctagggtgataatggggcaaactaaaagtaaagttaaaagtaaatatgcctcttatctcagctttattaaaattcttttaaaaagagggggagttaaagtatctacaaaaaatctaatcaagctatttcaaataatagaacaattttgcccatggtttccagaacaagaaactttagatctaaaagattggaaaagaattggtaaggaactaaaacaagcaggtaggaagggtaatatcattccacttacagtatggaatgattgggccattattaaagcagctttagaaccatttcaaacagaagatagcgtttcagtttctgatgccactggaagctgtataatagattgtaatgaaaagacaaggaaaaaatcccagaaagaaaccgaaagtttacattgcgaatatgtagcagagccggtaatgactcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaacgcaggttaaagaaaataagacccaaccgccagtagcctatcaatactggccaccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcgaaagagccctaccctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagctactaccacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaaaaaccccccctccctgtcccaagtgtttcagggaataagccagttaccacaatacaacaattgtcccccgccacaagcggcagtgcagcagtagatttatgtactatacaagcagtctctctgcttccaggggagcccccacaaaaaatccccacaggggtatatggccccctgcctgaggggactgtaggactaatcttgggaaaatcaagtctaaatctaaaaggagttcaaattcatactggtgtggttgattcagactataaaggcgaaattcagttggttattagctcttcaattccttggagtgccagtccaggagacaggattgctcaattattactcctgccatatattaagggtggaaatagtgagataaaaagaacaggagggtttggaagcactgatccaacaggaaaggctgcatattgggcaagtcaggtctcagagaacagacctgtgtgtaaggccattattcaaggaaaacagtttgaagggttagtagacactggagcagatgtctctatcattgctttaaatcagtggccaaaaaattggcctaaacaaaaggctgttacaggacttgtcggcataggcacagcctcagaagtgtatcaaagtacggagattttatattgcttagggccagataatcaagaaagtactgttcagccaatgattacttcaattcctcttaatctgtggggtcgagatttattacaacaatggggtgcggaaatcatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggccactgtagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcattctcgccttggaattctcctgtgtttgtaattcagaagaaatcaggcaaatggcgtatgttaactgacttaagggccgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatattaagaggagactcagacttaaatagtaaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaaatgactacttggattctacctaaaattaccagacgtgaacctttagaaaatgctctaacagtatttactgatggttccagcaatggaaaagcagcttacacagggccgaaagaacgagtaatcaaaactccatatcaatctgctcaaagagcagagttggttgcagtcattacagtgttacaagattttgaccaacctatcaatattatatcagattctgcctatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaagaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcgtatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccacggagatggtaacacc

SEQ ID NO: 134 - DNA, 3490 bp, Homo sapiens
gtcaggcctctgagcccaagctaagccatcatatcccctgtgaccttcatgtacacatccagatggccggttcctgccttaactgatgacattatcttgtgaaattccttctccttgctcatcctggctcaaaagctcccctactgagcaccttgtgacccccactcctgcctgccagagaacaacccccctttttcctttacctacccaaatcctataaaatggccccaccccatctcccttcactgactctctttttggactcagcccacctgaacccaggtgaaataaacagctttattgctcacacaaagcctgtttggtggtctcttcacatggatgcatgtgaaatttggtgctgtgactcggattgggggacctcccttgggagatcaatcccctgtcctcctgctctttgctctgtgagaaagatccacctacgacctcaggtcctcagactgaccagcccaagaaacatctcaccaatttcaaatctgggaagcagcttctttttactctcttctccaacttccctcactatccttcaacctctttctcctttcaatcttggcaccacacttcaatttctcccttctcttaatttcaattcctttcattttccggtagagaccaaggagacacgttttatctgtggacccaaaactccggtgccggtcgcggactagggaaggcagccttcccttggtgtttaatcattgcagggacgcctctctgattattcacccaggtttcagaggtgtcataccacgcagggacacctgccttggtccttcacccttagcagcaagtcctgcttttctgggggaggcacaggaaacccaccctcttatctctgcaccccgatcccttatttccatgccccgccctcttatctctgtgccctgatcccttatttccacaacctgacctcctatctctgcaccccaaccctttatttctgtgccccaacccatttcctgcttttctggaaggcaagaccaccccaccccttctctttgtgtctctactctctcttttctctaggcttgcctccttcactatgggcaagcttccactctccattcccctttcttctccattagcctgtgttcttcaaaacctaaaacctcttcaactcacacctgacctaaaacctaaatgccttattttcttctacaatgccgcttgaccccaatacaaactcaacagtggttccaaatagccagaaaatggcactttcaatttttccatcctacaagatctagataattcttgtcataaatgggcaaatggtctgaggcgcctcacgtccaggcattcttttacacatcggtccctccctagtctctgttcccaaagcaactcatcccaaatcttctttctttccctcccacctctcccctcagtcccaaccccaagtgtctctgagtctttctaatcttccttttctacagacccatctgacctctccccttcttgccaggctgagctaggtcccaattcttcctcagcctctgctcctccaccctataatccttttatcacctcctctccttacactgggtctggcttacagtttcattccatgactagccctccccaacctgcccagcaatttactcttaaaaaggtggctggagctaaaggcatagtcaaggttaatgctcctttttctttatcccaaatcagataaggtttaggctcttttgcatcaaatataaaaatccgccccagttcatggctcgtttggcagcaaccctgagacgctttacagccctagaccctaaaaggtcaaaaggccgtcttattctcaatatacattttattacccaatctgctcccgacattaaataaaattccaaaaattaaattccggccctcaaaccccataacaggacttaattaacctcgccttcaaggtgtacaataatagagtacaggcagccaagtagcaacatatttctcagttgcaattccttgcctccactgtgagacaaaccccagccacatctccagcacacaagagcttccaaacgcctaaagcgcagtggccaggcgttcctccagaatcgcctctcccaggagcttgctacaagtgccagaaatctgaccaccaggccaaggaatgcctgcagcccgggattcctcctaagccatgtcccatctgtgcgggaccccactagaaatcggactgttcagctcacctggcagccactcccagagcccctggaactccagcccaaggctctctgactgactccttcccagatcttcttggcttagcagctgcagaccgacactgcccaatcgatcgcctcggaagcctacaggaccatcacagacgctctaggttactctcacagtggagtgtaagtccatccccttcttaatcaatacagaggctacccactccacattaccttcttttcaagggcctctttcccttgcctccataactgttgtgggtattgacagccagtcttctaaacctcttaaagctccccaactctggtgccaacttagacaatactcttttaagcactcctttttagttatccccacctgcccagttcccttattaggccgagacacttcaactaaattatctgcttccctgactattcccggactacagatacatctcattgccacccaccttaacccagaagtagaagatacctctactccctccttggcgacctatcatgcaccccttaccatctcagtaaaacctaatcatccttaccccgctcaatgccaatatctcatcccacagcatgctttgaaaggattaaagcctgttaccactcacctgctacagcatggccttttaaagcctataaactctccttacaattcccccatcttacctgtcctaaaaccagacaagccttacaagttagttcaggatctatgacttatcaatcaaattgttttgcctatccaccccaaggtgccaaacacatatactctcatatcctcaattcctccctccacaacccattattctgttctggatctcaaacatgctttctttactattcctttacacccttcatcccagccactcttcgctttcacttggactgaccctgacacccatcaggctcagcaaattacctgggctgtactgctgcaaagcttcacagacagcccccattacttcagtcaagcccaaatttcttccttatctgttacctatctccgcataattctcataaaaacacacgtgctctccctgccgatcgtgtgtgactaatctctcaaaccccaaccccttctacaaaacaacaactcctttccttcctgggcatggttggatactttcatctttagatatctggttttgccatcctaacaaaaccattatataaactcacaaaaggaaacctagctgaccccatagatcctaaatcctttcctcactcctctttctgttccttgaagacagctttaaagactgcccccatcctagtcttggttccctgac

SEQ ID NO: 135 - DNA, 414 bp, Homo sapiens
gtcaggcctctgagcccaggcctgcacgaatacatccagatggcctgaggcaactgaagaaccacaaaagaagtgaaaatggccggttcctgccttaactgatgacattccacccttgtgatttgctcctgccccaccctaactgatgaattaaccttgtgacattccttctcctggacaatgaatatcagagccttctcaccagcaccttgtgacccccactcctgcaccttgtgaacaaccccctttaactgtaattttccactacctacccaaatcctataaaactgcctcacccctatctccctttgctgactcccttttcggactcagtccgcctgcacccaggtgattaaaaagctttattgctcacacaaagcctatttggtgttctcttcacacagacgggcataa

SEQ ID NO: 136 - DNA, 2741 bp, Homo sapiens
tgggtcaggtgcaaagtaagcccaccccactgggacctatgttaaaaaaattttttttcaagagagaatttaaaggagattacggtgttagtatgacaccaggaaaacttagaactttgtgtgaaatagactggctagcattagaggtaggttggccaccagaaggaagcctggacaggtcccttgtttcaaaggtatggcacaaggtaacctgtaagccaaagcacccagaccggtttctgtacatagacagttacagctggttttagaccccctttcccccaccacagtagttaagagaacagcagcataagcggctggcagagccaaggaacgaccagaaaagagaaaaagaggccatctgtaccaattctaagagtttagactaaacaagttcttattaatagcaaaggataattgaaatctcaaacttacaaggttttcaacaaaagtgaagtttgctaaaagttaacagtgtaacatgtattttggtaacttctaatcttgtggccttagacagtctagtccaaagacataaagaaagttcgcttttttaaaaaggaaagaaaaggggggaggcagaatttatattaaaaaaaagttatatggtaaattcttgtcctgaaataaattaactggttgtttaaagaaaaaaaagtttgttaatcagtcaaaaaattgagacatgttaaaaaattgtctgggaaagtcgtgagaaaaaaattataaaaaaaaatttttatgcaaaaaatattgtataatttaaaagtaatgaggcctcctgagtactatttaaaaaaaaaaaaccagttcatgtgcaagatgtataagaaaagtaaaatatacctttggtaaaaaaaaaaattataaaggggcataaacgtggatttttacctacattaaaaggttaaaaaaattattgttttaaaagtttaagcaagctttaaaacgttaattataaaaaaaattctgtgtgtaaacatattagctaaggttaaaaaggtatcatccagtttttctgtgaactggacattaaagtaaaaatgcaagaggtttttcttaaagcatcaacctgctctttaacaaaaattataaaaggttaaaaagagtctataaaatcttaccttatggtcaaacataaaaaattggataaatatgtctacaaggttttattaaaattaagtttaacattaataacacactaatataaaggtaaaatttagcttatctggtataaaagtcatacaggaagcattagtaaatataaaatagtgtttagctttcttttgtctaaaaactaataaaaattggtgctaaaggaagcattcattttactagaggatcataaaagttaaagacttaaaacaaactttggcaattaagacagcataccaagatgcaaatgcctggttgaaatggatcaaatattccatctgcaggttaaacaaaagcaattagcatgcttgtgcacatggcaggccagaggccctgattgtcccccttccactaaggtggtcctccagtcggccaggcatgggctgcatggtagctcttttccaggattctatagcctggagtaataagtcatgccaagctctctctgctatatcccaaagtccctgcaggtcagcccccgagggccatccagcttccatctcccaacactaagttcactacgtgtctctcatggcagggaggagacttagcattccttggagacctgaagggatgcagtgagcttaagaattttcaagagcttatcaatcagtcagcccttgttcatcccaaagcggatgtgtggtggtattgtggtagacctttattggggactctgccgagtaactagagtggcacttgtgctttagtccatttggctatccctttcaccctgacatttcatcaacaagaggaaaaaataataataagaagaagacatcataaagcgagaaaagctccttataggtctttcaactctcacatctatttagatgcaattgaagccccgcaaggagtcccagatcaatttaaagcttgaaatcaaatagttacaggatttaagtcaatattttggtagatgacagtcaataaaaatgtagattagataaactacatctattacaaccaacagcaacgagcttttcatgagttaaaaagaaaaactcatgtcggccccagccctgaggctacctgacctgacaaaactctttacgctctatgtgtcagaaacaaaaaaaatggcagttagagttttaacccagactgtagggccctggccaaggccagtggcctatctctcaaaacaactagatggggtttccaaaggctggcccccatgtccaagggccctggtagcaacggccctgtcacaagaagcagataagctaactcttacacaaaacctaaacataaactccccccatgctgtggtgattttaataaataccaaaggacaccatgctagatgaatgctagactaactagatgccaaagctagctctgtgaaaatccccacataaccattgacgtttgcacaccctaaaccctgccaccttcctcctggtatcagagagcccagttaaccatatctggactcagtttattctagtaggcccaaccaccgagaccacccttaaacatcagtaggctgggagctgtacatggatgggagcagcttcgccaacccctgcaaagtgactctgaagaagacgacaagccctgctccagtcacacctggaagctga

SEQ ID NO: 137 - DNA, 72 bp, Homo sapiens
aaggccgccttattcttaataggcattgcatcacccagtcagctcctgacattagaaaaaagcttcaaaaat

SEQ ID NO: 138 - DNA, 5924 bp, Homo sapiens
tggggcaaactaaaagtaaaattaaaagtaaatatgcctcttatctcagctttattaaaattcttttaaaaagagggggagttaaagtatctacaaaaaaatctaatcaagctatttcaaataatagaacaattttgcccatggtttccagaacaaggaactttagatctaaaagactggaaaagaattggtaaggaactaaaacaagcaggtaggaagggtaatatcattccacttatagtatggaatgattgggccattattaaagcagctttagaaccatttcaaacagaagaagatagcgtttcagttcctgacgcccctagaagctgtatagtagattgtaatgaaaagacaaggaaaaaatcccagaaagaaatggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaagccacgagggccaagtcctcttccagcaggtcaggtgcccgtaacactacaacctcaaacgcaggttaaagaaaataagacccaaccgccagtagcttatcaatactggccgccagccgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcgtggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaaatccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataagtcaaaattggagtactattagtcaacaagcattaatgcaaaatgaggccattgagcaagttagagctatctgccttagagcctgggaaaaaatccaagacccaggaagcgcctgcccctcatttaatacagtaagacaaggttcgaaagagccctaccctgattttgtggcaaggctccaagatgttgctcaaaagtcaattgccaatgaaaaagcccgtaaggtcatagtggagttgatggcatatgaaaacgccaatcctgagtgtcaatcagccattaagccattaaaaggaaaggttcccgcaggatcagatgtaatctcagaatatgtaaaagcctgtgatggaatcagaggagctatgcataaagctatgcttatggctcaagcaataacaggagttgttttaggaggacaagttagaacatttggaggaaaatgttacaattgtggtcaaattggtcacttaaaaaagaattgcccagtctcaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgaccaaaggggccagcctcaggccccacaacaaactggggcattcccaattcagccatttgttcctcagggttttcagggacaacaaacccactgtcccaagtgtttcagggaataagccagttaccacgatacaacaattgtcccccgccacgagcggcagtgcagcagtagatttatgtactatacaagcagtctctctgcttccaggggagcccccacaaaaaatccccacagaggtatatggcccactgcctgagaggactgtaggactaatcttgggaagatcaagtctaaatctaaaaggagttcaaattcatactggtgtggttgattcagactataaaggcgaaattcagttggttattagctcttcaattccttggagtgccagtccaggagacaggattgctgaattattactcctgccatatattaagggtggaaatagtgaaataaaaagaacaggagggtttggaagcactgatccgacaggaaaggctgcatattgggcaagtcaggtctcagagaacagacctgtgtgtaaggccattattcaaggaaaacagtttgaagggttggtagacactggagcagatgtctctatcattgctttaaatcggtggccaaaaaattggcctaaacaaaaggctgttacaggatttgtcggcataggcacagcctcagaagtgtatcaaagtactgagattttacattgcttagggccagataatcaagaaagtactgttcagccaatgattacttcaattcctcttaatctgtggggtcgagatttattacaacaatggggtgcggaaatcatgcccgctccattatatagccccacgagtcaaaaaatcatgaccaagatgggatatataccaggaaagggactaggaaaaaatgaagatggcattaaagttccagttgaggctaaaataaatcaagaaagagaaggaatagggtatccttgttaggggcagccactgtagagcctcctaaacccataccattaacttggaaaacagaaaaaccggtgtgggtaaatcagtggccgctaccaaaacaaaaactggaggctttacatttattagcaaatgaacagttagaaaagggtcacattgagccttcgttctcgccttggaattctcctgtgtttgtaattcagaagaaatcaggcaaatggcgtatgttaactgacttaagggccgtaaacgccgtaattcaacccatggggcctctccaacccgggttgccctctctggccatgatcccaaaagactggcctttaattataattgatctaaaggattgcttttttaccatccctctggcggagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagacaagttttcagactgttatattattcattatattgatgatattttatgtgctgcagaaacaaaagataaattaattgactgttatacatttctgcaagcagaggttgccaatgcaggactggcaatagcatctgataagatccaaacctctactccttttcattatttagggatgcagatagaaaatagaaaaattaagccacaaaaaataaaaataagaaaagacacattaaaaacactaaattattttcaaaaattgctgggagatattaattggattcggccaactctaggcattcctacttatgccatgtcaaatttgttctctatcttaagaggagactcagacgtaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaattggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaggaacgagtaatcaaaactccacatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaataaactgtaagaaaaagaaatttcccattttatattactcatattcgagcacacagtaatttaccagggcctttgactaaagcaaatgaacaagctgacttactggtatcatctgcattcataaaagcacaagaacttcatgctttgactcatgtaaatgcagcaggattaaaaaacaaatttgatgtcacatggaaacaggcaaaagatatcgtacaacattgcacccagtgtcaagtcttacacctgcccactcaagaggcaggagttaatcccagaggtctgtgtcctaatgcattatggcaaatggatgtcacgcatgtaccttcatttggaaaattatcatatgttcatgtaatagttgatacttattcacatttcatatgggcaacttgccaaacaggagaaagtacttcccatgttaaaaaaacatttattgtcttgttttgctgtaatgggagttccggaaaaaatcaaaactgacaatggaccaggatattgtagtaaagctttccaaaaattcttaagtcagtggaaaatttcacatacaacaggaatgccttataattcccaaggacaggccatagttgaaagaactaatagaacactcaaaactcaattagttaaacaaaaagaagcaggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacgcactagacatttgaagttctacaatgaacccatcggagatgcaaagaaaagcacctccgcggagacggagacaccacagtcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaacggtggtaagtctccctatgcctgcaggagcagctgcagctaactatacctactgggcctatgtgcctttcccgcccttaattcgggcagtcacatggatggataatcctatagaagtatatgttaatgatagcgtatgggtacctggccccacagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatg

SEQ ID NO: 139 - DNA, 3476 bp, Homo sapiens
ggctctggaaaagggaagagctgggcaaactgaatgctaatagggcttgcttccagtgcggtctacaaggacactttaaaaaagattgtccaaatagaaataagccgccccctcgtccatgtcccttatgtcaagggaatcactggaaggcccactgccccaggggatgaaagtcctccgagtcagaagccactaaccagatgatccagcagcaggactgagggtgcccgggccaagtgccagcccatgccatcaccctcacagaaccccgggtatgcttgaccattgagggtcaggaggttaactgtctcctggatgctggcacgaccttctcagttttactctcctgtcccagacaactgtcctccagatctgtcactatccaaagggtcctaggacaggcagtcactagatacttctcccagccactaagctgtgactggggaactttattcttttcatatacttttctaattatgcctgaaagccccactcccttgttagggagagacattctagcaaaagcaggggccattatacacctgaacataggagaaagaacatccatttgttgtcccctgcttgaggaaggaattaatccatcctgaagtctgggcaacagaaggacaatatggacgaacaaagaatgcctgtcctgttcaaattaaactaaaggattctgcctcctttccctaccaaaggcagtaccctcttagacccaaggcccaacaaggactccaaaaaattgttaaggacctaaaagcccaaggcctagtaaaaccatgcaatagctcctgcaatactccaattttaggagtacagaaacccaacagacagtggaggtcagtgcaagatctcaggattatcaatgaggctcttatccctctatacccagctgtacctaacccttgtactctgctttcccaaataccagaggaaccagagtggtttacagtcatggaccttaaggatgcctttttctgcatccctgtacatcccaactctcaattcttctttgcctttgaagatccttcaaacccaacgtctcaactcacctggactgtcttatcccaagggttcagggatagcccccatctatttggccaggcattagcccaagactttagccagttctcatacttggacactcttgtcctttggtacgtggatgatttacttctagccgcccattcagaaaccttgctccatcaagccacccaagcgcttttaaacttccttgccacttgtggctacaaggtttccaaaccaaaggctcagctctgcttacagcaggttaaatacttaaggctaaaattatccaaaggcactagggccctcagtgaggaatgtatccagcatatactggcttatcctcatcccaaaaccctaaagcaactaagagggctccttggcataacaggcttctgccgaatatggattcccaggtatggcaaaatagtcaggccattaaatacactaattaaggaaactcagaaagccaatacccatttagtaagatggacacctgaagcagaagcggctttccaggccctaaggaaggccctaacccaagccccagtgttaagcttgccaacggggcaagacttttctttatatgtcacagaaaaaaaataggaatagctctaggagtccttacacaggtctgagggaccagcttgcaacctgtggcatacttgagtaagaaaattgatgtagtggcaaagggttggcctcattgtttacaggtagtggcagcagtagcagtcttagcctccgaagcagttaaaataatacaaggaagagatcttatgtgtgtggacatctcatgatgtgaacagcatactcactgctaaaggagacttgtggctgtcagacaaccattagcttaaatatcaggctcttatttgaagggccagtgctgcgactgcgcacttgtgcaactcttaacccagccacgtttcttccagacaatgaagaaaagatagaacataactgtcaacaggtgattgctcaaacctacgccgctcgaggggaccttctagaggttcccttgactgatcccaacctcaacttgtatactgatggaagttcctttgtgaaaaaaggacttcaaaaagtggagtatgcagtggtcagtgataatagaatacttgaaagtaatcccctcactccaagaactagcattcagctggcaaaactaatagccctcactcgggcatcagaattaggaaaaggaaaaatggtaaatatatatacagactctaagtatgcttacctagtcctccatgcccacacagcaatatggagagaaagggaatttctaacttccgagaacacctatcaaacatcaggaagccattaggagattattattggctctacagaaacctaaagaggtggcagtcttacactgccggggtcatcagaaaggaaaggaaagggaaatagaagggaaccgccaagcggatattgaagccaaaagagctgcaaggcgggaccctccattagaaatgcttatagaaggacccctcttatggggtaaccccctccaggaaaccaagccccaatactcagcagaagaaatcgaatggggaacctcacgaggacatagtttcctcccctcaggatggctagccacgaaagaaggaaaaatacttttgcctgcagctaaccaatggaaattacttaaaacccttcaccacacctttcacttaggcattgatagcacccatcagatggccaaatcattatttactggaccaggccttttcaaaactatcaagcagatagtcaaggcctgtgacgtgtgccaaagaaataatcccctgcactgcagggtattatttgaatacatttgaatccctgtatctttaacctccttgttaagtttgtctcttccagaatcaaaggtgtaaaactacaaatcgttcttcaaatggagccccagatgcagtccatgactaagatctaccgaggacccctggaccagcctgctagaccatgctccaatgttgatgacatcgaaggcacccctcccaaggacccctgcatgacccctactacactccaattcagcaggaagcagttagagcggttgtcggccaacctccccaagagcacttgggttttcctgttgagaggaggtaccgagagacaagactagctggatttcctaggccgactaagaatccccaagcctagctgggaaggtgacgcatccacctttaaacacagggcttgcaacttagctcacacccaaccaatcaagtagtaaagagagctcactaaaatgctaattaggcaaaaacaggaggtaaagaaatagccaaacatctatcgcctgcctgagagcacaggggaaggaacaatgatcgggatataaacccaggcatttgagctggcaatggctacccactttgggtcccctccctttgtatgggagctctgttttcactctattacatcttgcaactgca

SEQ ID NO: 140 - DNA, 6181 bp, Homo sapiens
gtcaggcctctgagcccaagctaagccatcatatcccctgtgacctgcacgtatacatccagatggcctgaagtaactgaagaatcagaaaagaagtaatatttaaatggcctgttcctgccttaactgatgacattccaccacaaaagaagtgaaaatggctggtccttgccttaactgatgacattaccttgtgaaattccttctcctggctcatcctggcctaaaaagctccctgactgagcactttgtgacccccactcctgcctgccagagaacaacccctctttttcctttacctacccaaatcttataaaacagccccacccctatctccctttgctgactctctttttggactcagcctgcctgcacccaggtgaaataaacagccttgttgctcacacaaagcctgtttggtggtctcttcacatggatgcgagttaaattttggtgctgtgactcagatcaggggacctcccttggcagatcaatcccctgtcctcctgctctttgctccgtgagaaagatccacctacaacctcagatcctcagactgacctgcccaaggaacaccacacccattttaaatcaggtaagcggcctctttttactctcttctccaacctctctcactatccctcaacctctttctcctttcaatcttggcgccacacttcagtctctcccttctcttaatttcagttcctttccttttctcatagagacaggagacgcattttatccggacccaaaactccggcgccagtcacggactcaggaagacagtcttcccttggtgtttaatcacatggggatgcctgcctgattattcatccacgtttcagaggtgtctgaccacgcgaggaagcctgccttggtccttcacccttagtggcaagtaccacttttctggggggcaagaaccccccgaccccttctctccatgtctctatcccttctctgcttttctagggggcaagaaccccctgactccttctctccatgtctctaccccttctctgcttttctggaaggcaagaaccccccagccccttctccttcacccttagcagcaagtactgcttttctagggggcaacaacccccccaaccccttctctccgtgtctctactgcttctccacttttgtggggggcaagaaccccccaacccctcctctccgtgtctctaccccttttccactttcctgggggcaagcaccccccaccccttctctccgtgtctctactctctcttttctctgggcttgcctccttcactatgggcagccttccaccctccattcctccttcttctcccttagcctgtgttctcaagaacttaaaacctcttcaactcacacctgacctaaacctaaatgccttatttttcttctacaatgccgcttgaccccaatataaactcgatagttgttccaaatagccagaaaacagcactttcaatttttccatcctacaagatctagataattcttattgtaaaataggcaaatagtctgaggtgcctgacgtccaggcattcttttacacattgttccctccctagtctctgttcccaatgtgactcatcccaaatcctccttctttccctcccgcctgtcttcccagtcccaaccccaagcgtcgctgagtctttctaatcttccttttctacagacccatctgacttctccccttctccccaggctgctcctagccaggctgagccaagtcccaattcttcctcagcctctgatcccccacactataatccttttatcacctcccttcctcacaccgggtccagcttacagtttccttccacaactagccctcccccacctgcccagcaatttcctcttaaaaaggtggctggagctagaggcatagtcaaggttaatgctcctttttctttatcagacctctcccaaaatcagttagcatttaggctctttttcatcaaatatgaaaaacccagcccagttcatggcttgttcggcagcaaccctgagacgctttacagccctagaccctaaaaggtcaaaaggccatcttattctcaatatacattgtattacccaatctgctcctgacattaaataaaactccaaaaattaagttccagccctcaaaccccacaacaggacttaattaacctcaccttcaaggtgtacaataatagagtagaggtagccaagtagcaatgtatttctgagttgcaattccttgcctccactgtgagacaaaccccagccatatctccagcccacaactccaaatgcctgaactgcagctgccgggggttcctccagaacctcctcccccaggagcttgctacacatgccagaaatctggccactgggccaaggaatgcccacagcccgggattcctcgtaagccatgacccatctgtgtgggaccccactgaaaattggactgttcaactcacctggcagccatttccagagaccctggaactctggcccaaggctctctgactccttccccaatcttctcagcttagtggctgaagactgacactgcccgatcgcctcagaagccccctaaaccatcacggatgctgagcttcaggtaactctcacaatggaaggtaagtccgtcccattcttaatcaatacggacgctacccactccacattaccttcttttcaagggcctgtttcccttgcctccataactgttgtaggtattgatggccaggcttctaaacctcttaaaactccccaactctggtgctaacttagacaatactcttttaagcactcctttttagttaaccccacctgttcagttcccttattaggctgagacactttaactaaattatctgcttccctgactattcctgggctacagccacacctcattgccatcttttcccccagttcaaagcctccttcacatcctccccttgtatctccccaccttaacccacaagtataagacacctctactccctccttagtgaccgatcatgcaccccttaccatcccattaaaacctaatcacccttaccctgctcaatgccaatatcccatcccacagcatgctttaaaaggattaaagtctgttatcactcacctgctacagcatggccttttaaagcctataacctccccttacaattcccccattttacctgtcctaaaaccagacaaggcttacaggttagttcaggatctgcgccttatcaaccaaattgttttgcctatccacactgtggtgccaaacctatatactctcctatcctcaatacccattattaataccctcaataccctccacaacccattattctgttccagatctcaaacttgctttctttactattcctttgcacccttcatcccagcctctcttccctttcacttggactgaccctgacacccatcaggctcagcaaattacctgggctgtactgctgcaaggcttcacagacagcccccattacttcagtcaagcccaaatttcttccttatctgttacctatgatggcataattctcataaaaacacacgtgctctccctgctggtcatgtctgactgatctctcaaaccccagcaccttctacaaaacaactcctttccttcccaggcatggttagatactttcaactttagatacctggttttcccattataacaaaaccattatataaactcacaaaaggaaacctagctgactccatagatcctaaatcctttccccactcctctttccattccttgaagacaactttagagactgcccccactctagctctccctgactcatcccaacccttttcattacccacagctgaagtgcagggctgtgcagtcagaattcttacacaaggaccaggatcgcatcctgtagcctttttatccaaacaacttgaccttactgttttgtctagccctcaagtctgcgtgcagcagctaccaccaccctaatacttttagaggcccttaaaatcacaaactatgctcaactcactctctacagttctcttaacttccaaaacctattttcttcctcacacctgacacgtatactttctgctccctggctccttcagctgtactcactctttgttgagtctcccacaattaccattgttcctggcctggacttcaatccggcctcccacattattcctgataccacacctgaccgccatgactgtatctctctgatccacctgacattcaccccatttccccatatttccttctttcctgttcctcaccctgatcacagttggtttattgatggcagttccaccaggcctaattgccacacaccagcaaaggcaggctatgctatagcacaagccactagccaacctctaagaacctctcatttcttttccatcgtggaaatctatcctcaaagaaataacttctcagtgttccatctgctattctactactcctcagggattgctcaggcctcccttcctttccctacacatcaagctcagggatttgcccctgcccaggactggcaaattagctttactcaacatgccccaagtcaggaaactaaaatacctcttggtcagggtagacactttcactggataggtagaggcctttcccacagggtctaagaaggccaccacagtcatttcttcccttctgtcagacataattcctcagtttggccttcccacctctatacagtcctataacagaccagcctttattagtcaaatcacccaagcagtttttcaggctcttagtattcagtgaaacctttatgtcctttacagtcctcaatcttcaggaaaggtagaacggactaatggtcttttaaaaacacacctcaccaagctcagccaccaacttaaaaaggactggactggccgggcaccgtggctcatgcctgtaatcccagtactttgggaggctgaggcaggcagatcacgaggtcaggagatcgagaccattctggctaacacggtgaaaacctgtctctactaaaaatacaaaaaattagccaggtgtggtggcaggtgcctgtagtcccagctactccggaggctgaggcaggagaatggcatgaacccaggaggcggagcttgcagtgagccaagatcgtgccactgcactccagacagagtgcagtgcaagactccatctcaacaaaaaaaaaaaaggactggacaatacttttaccactttcccttcgcagaattcaggcctgtcctcagaatgctataggttacagcccatttgagctcctgtatagacactcctttttattaggtcccagtctcattccagacaccagcccaacttgaactgcaccccaaaaacttggatagagcctaaaaattcaccaaccaagcaagtaattacgctgaacccccttgggcactctctaattagatgtcctgggtcctcccaattcttagtctaatatctgtttttctccttctcttattccatttagtttttcaattcacacaaaacagtatccaggccatcaccaataattctatacaacaaatgtttcttctaacaaccccataatatcgccccttaccataaaatcttccttcagcttaatctctcccactctaggttcccacgccgcccctaatcccgctcgaagcagccctgagaaacatcgcccattatcaatccatgccaccccccaaaaaaattttctccccaccccaacacttcaacactattatgttttatttttcttattaatacaagaagagaggaatgtcaggcctctgagcccaagctaagccatcacatcccctgtgacctgcacatctacatccagatggcctgaagtaactgaagaatcacaaaagaagtgatatttaaatggcctgttcctgccttaactgatgacattccaccacaaaagaagtgaaaatggctggtccttgccttaactgatgacattaccttgtgaaattccttctcctggctcatcctggcctaaaaagctccctgactgagcaccttgtgaccccccactcctgcctgccagagaacaacccccttttttcctttacctacccaaatcttataaaatggccccacccctatctcccttcgctgactctctttttggactcagcccgcctgcacccaggtgattaaaagctttattgctcacacaaagcctgtttggtggtctcttcacacaga

SEQ ID NO: 141 - DNA, 812 bp, Homo sapiens
gtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcccgtccctgggcaatggaatgtctcggtataaaacccgactgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgactcatccccaccttaggagaaacacccacaggtgtgtaggggcaacccacccctaca

SEQ ID NO: 142 - DNA, 246 bp, Homo sapiens
tacttgggaggtcagcaatgttaattaccctctagtggtgtttacttaagacctttgtccttaaatctgtactgaataaatgcctggagccccagcctgtcagggccacagctgctgactctttacagcaccctcctcagtgtctgggagctgccggtcccctagcctgctgtttcatgggatacctgtgtctgagtgcatttcttcatccgtcacacggccagggtatggaggttggacccagca

SEQ ID NO: 143 - DNA, 1023 bp, Homo sapiens
ttagagtaggtagttaggcggacaagagcagggcaggaaagcccccccccccaatccaggaatgtcaggtgaccatcagatgatggtcaggagattgttaaactatctctctaaaataatcattgaaggccagttgtggtggctcatgcctgtaatcctagcattttgggaggctgaggtgggtggatcactccttgaggtcaggagtttcagaccagccaggccaacatggtgaaaccctttctctactaaaaataaaaaaaaaaaaaattagctgggcatggtggcacactcctgtaatcccagctactggggaggctgaggcaagagaatcacttgaacccaggagtcagagcttgcagtgagctgagattgcaccactgcactctagtctgggtgacagagtgagactccgtctcaaaaaataattaattaaataaaataataattggtcgcagctggtgccagggaaaggcagtctcccaacagacagaagacacttgaggctgatgatcagcagcttcctgagaagatctcaggagttggatgagtgggctcaagcatgcacactaagaggcaaaatggtggagtttaacttgtatatgaccttcctctaggaacactagactggtaagggaaaaacgccttaaatgagcatatgcacaacttcagtaaatacagtgtatgcggcccgcccaagtgctggcaggccagtgtgcatgcggacagcctgccccaaggaaaatcaagagaggagagatgcaagtcctggaaccatgccaatgtataaaaccccaagtcaggggtcagatggggcacttggatttctcaagtcatccacttggccctcttccaagtgtacttcctttcgttcctcctctaaaattttttaataaactttcattcctgctctaaaacttcagtcagtctctcactgtgccatatgccccttggccaaattctttcctccaaggaggtgagaattgagcttgctgcaaacccgtatggattcactgctgctaa

SEQ ID NO: 144 - DNA, 87 bp, Homo sapiens
aaaaggacttgtatttatagccagacgacctactcagttactcaatttgtgaccaggaaataaccaaccttatgtatgttataaccc

SEQ ID NO: 145 - DNA, 3585 bp, Homo sapiens
gtcaggcctctgagcccaagttaagccatcatatcatcccctgtgacccgcatgtacacatccagatggccggttcctgccttaactgatgacattccaccacaaaagaagtgaaaatggcctgttcctgccttaactgatgacattgccttgtgaaattccttctcctggctcatcctggctcaaaagctcccccactgagtaccttgtgacccccactcctgcccgccagagaacaaccccctttgactgtaattttcctttacctacccaaatcttataaaacggccccacccctatctcccttggctgactctctttttggactcagcccgcctgcacctaggtgaaataaacagctttattgctcacgcaaagcctgtttggtggtctcttcacatggacgcgcatgaaatttggtgccatgactcagatcgggggacctcccttgggacatcaatcccctgtcttcctgctctttgctccatcagaaagatccacctatgacctcaggtcctcagaccaaccagcccaaggaacatctcaccaattttaaatccagtaagtgacctcttcttactctcttctccaacctctctcactgtccctcaaccactttctcctttccactcttcaatctctcccttctttcaatttcaattcctttcattttctggtagagataaaggagacacgttttatccgtggacccaaaactccggcgccagtcacggactgggaaggcagccttcccttggtgtttaatcatgcagggacgcctctctgattattcacccatgtttcagaggtgtcagaccacgcagggacgcctgccttggtcctttgcccttagcggcaagtcccgcttttctggggtaggggcaggtaccccaaccccttctctccgtgtctctaccccttctccgcctttctgggggacaagaaacccccaaccccttctccttcacccttagcggcaagtcccgcttttctagaggagaggcaagtaccccaacctcgtatctctgtgccccaatcccttatttccatgcaccgacctcttatatctgtgccccaatcccttatttccgtgccccaacctcttacatctctgtgccccgatcccttatttccgtgccccaacctcttatatctctgcgccctgatcccttatttccacaccctgacctcgtatctctgtgccctgacccctttcccacttttctggagggtaagaacccccgaaccgcttccctctgtgtctctactctcccttttctttaaacttgcctccttcactatgggcaaccttccaccctccattcctccttcttcgcccttagcctgtgttcttaagaacttaaaacctcttcaactctcacctgacctaaaatctaagcatcttattttcttctgcaatgccacttgaccccaaacaaactcgactgcagttccaaatagccagaaaacggcactttcaatttttccatcctgcaagatctaaataattcttgtaaaatgggcaaatggtctgagatgcctgacgtccaggcattcttttacacattggtccctccctagtctctgtgcccagtgcaactcgtcccaaatcttccttctttccctcccacctgtcccctcagtcccaaccccaagcattgctgagtctttctaatcttccttttctacagacccatctgacctctcccctcctccccagactgctcctcaccaggccgagctaggtcccaattcttcctcagcctctgctcccccaccgtataatctttttatcacctcccctcctcacacccggtccagtttacagtttcattccttgagtagccctcccccacctgcccagcaatttcctcttaaaaaggtggctgaagctaaaggcatagtcaaggttaattcttctttttctttatcccaaatcacaagcgtttaggctgtttttaatcaaatataaaaacccagcccagttcatgactcctttggcagcaaccctgagccactttacagccctagaccctaaaaggtcaaaaggtgtcttattctcaatatacattttattacccaatctgctcccgacattaaataaaactccaaaaattaaattccggccctcaaaccccacaacaggatttaattaacctcgccttcaaggtgtacaataatagaaaaaagttgcaattccttgcctccaccgtgagacaaaccccagccacatctccagcacacaagaacttccaaacgcctgaaccgcagcagccaggcattcctccagaacctccttccccaggagcttgctacaagtgccagaaatctggccactgggccaaggaatgcccacagcccaggattcctcctaagtcgtatcccatctgtgtgggaccccactgaaaatcagactgttcaactcacctggcagccactcccagagcccctggaactctagcccaaggctctctgactgactccttcccagatcttcttggcttagcagctgaagactgacactgcccgattgcctcagaagactacgggaccatcacagatgctctaagtaactctcagagtggagggtaagtctttctccttcttaatcaatacggaggctacccagtccacattaccttcttttcaagggcctgtttccctcaccccaataactgttgtgggtattgacggccaagcttcaaaatccctgaaaactcccccactctggtgccaacttggacaacactcttttaagcactcttttttaattatccccacctgcccagttcccttattaagccaagatattttaagcaaattatctgcttccctgactattcctggactacagccccatctcattgccgcccttctccccaacccaaagcctccttcacatcttcctctcatatccccccaccttaacccacaagtatgggacatctctactccttccctggcaaccgatcacatgcccattaccatcccattaaaacctaatcacccttaccccgctcaaccccaatattccatcccacagcataccttgaaaggattaaagcctgttatcactcacctgctagagcatggccttttaaagcctataaactctccttatcattcccccattttacctgtcctaaaaccagacaagccttacaagttagttcaggatctatgccttatcaaccaaattgttttgcctatccaccccatggtgccaaagccatatactcacctatcctcaatacctccctccacaacccattattctgttctggatctcaaacatgctttctttactattcctttgcacctgtcatcccagcatctcttcgcttgcacttggactgaccctgacacccatcaggctcagcaaattacctgggctgtactgccgcaaagcttcacagacagcccccattacttcactcaagcccaaatttcttccttatctgttacctatctcagcataattctcataaaaacacacgtgctctctctgctgatcgtgtccgattaatctcccaaacttcaatcccttacaaaacaacaactcctttccttcctagaaatggttag

SEQ ID NO: 146 - DNA, 5738 bp, Homo sapiens
gtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttctcccggctcatcccggctcagaagatcccctactgagcaccttgtgaccccccactcctgcccgccagagaacaacccccctttgactgtaattttcctttacctacccaaatcttataaaacggccccaccccatctctcttcactgactctttttggactcagcccgcctgcacccaggtgattaaaagctttattgctcacataaagcctgtttggtggtctcttcacacagacgtgcatgaaatttggtgccatgactcgcattgggggacctcccttgggagatcaatcccctgttctccggctctttgctccctgagaaagatccacctacggcctcaggtcctcagaccaaccagcccaagaaacatctcaccaatttcaaatcaggtaagcggcctcttcttattcccttctccaacgtctctcactatccctcaaccactttctcctttccactcttcaatctctcccttctcttaatttcaatttctttcattttctggtagagataaaggagacacattttatccgtggatccaaaactccggcgccagtcacggactgggaaggcagccttcccttggtgtttaatcattgcagggatgcctctctgatcattcacccaagtttcagaggtgtcagatcacacagggatgcctgccttggtccttcacccttagcggcaagtcccgcttttctgggggaagcgaaagtaccccaaccctttctctccatgtctctaccccttctccacctttctggggggcaagaaacccccaaccccttcttcacccttagcagcaagtcccgcttttctggaggaggggccagtaccccaacctcatatatctgtgccccaacctcttatatctctgcgccccaatcccttatttccatgcgccaacctcttatatctctgcgccccgatcccttatttccacaccccaacctcttatatctctgtgccccaatcccttatttctgtgccctgacctcatatctctgtgccccaaccccttctctgcttttctggagggcaagaaccccccaccccttctccgtgtctctactcttttctctcggcttgcctccttcactatgggcaagcttccatcttccatttctccttcttctcccttagcctgtgttcttaagaacttaaaacctcttcaactctcacctgacctaaaatctaagagtcttattttcttctgcaatgccgcttgaccccaatacgaactcgacagtagttccaaatagccagaaaatggcactttcaacttttccatcctacaagatctaaataattcttgtcataaaatgggcaaatggtctacggtgcctgatgtccaggcattcctttacatatcagtccctctctagtctctgttcccagtgcaactcatcccaaatcttccttctttccctcccacctgtcccctcagtcccaaccccaagcgtcactgagtctttctaatcttcctttctacagattaggggtcagacacatctgacctctcccctcctccccaggctgctcctcgccaggccaagctaggtcccaattcttcctcagcctccgcttctccaccctataatccttttatcccctcccctcctcacacctggtctggcttacagtttcgttccatgactagccctcccccacctgcccagcaatttactcttaaaaaggtggctggagctaaaggcatagtcaaggttaatgttcctttttctttatcccaaatcagatagcatttaggctctttttcatcaaatataaaaatccagcccagttcatgacttgtttggcaacaaccctgagacactttacagtcctagaccctaaaaggtcaaaaggccatcttattctcaaaatacattacccaatctgctcctgacattaaataaaactccaaaaattaaattccggccctcaaaccccacaacaggatttagttaacctcagcttcaaggtgtacaataatagaaacaagttgcaattccttgtctccactgtgagacaaaccccagccatatctccagcacacaagaacttccaaaggcctgaaccgcagcggccaggcgtggcattcctccagaacctcctcccccaggagcttgctacaagtgccagaaatctggccaccaggccaaggaatgcccgcagcccgggattcctcctaagctgcatcccatctgtgtgggaccccactggaaatcggactgtccaactcacctggcagccacgccactcccagagcccctggaactctggcccaaggctctcagactccttcccagatcttcttggcttagcggctgaagattgacgctgctcaagcgcctcggaagccccctagaccatcacggatgccgagcttcaggtaactctcacagtggaaggtaagtccgtccccttcttaatcaatatggaggctacccactccacattaccttcttttcaagggcctgtttcccttgcctccataactgttgtgggtattaacagccaggcttctaaacctcttaaaactccccaactctggtgccaatttagacaatactcttttgagcactccttttagttatccccacctgcccagttcctttattaggccgagacactttaactaaattatctgcttccctgactattcctggattacagctatatctcattgctgcccttcttcccaatccaaagcctcctttgcatcctcctcttgtattcccccaccttaacccacaacaataagatacctctactccctccttggtgaccaatcatgcaccccttaccatctcattaaaacctaatcacccttaccctgctcaatgccaatatcccatcccacagcatgctttgaaaggattaaagcctgttatcactcacctgctatagcatggccttttaaagcctataaactctccttacaattcccccattttacctgtcctaaaaccagacaagccttacaagttagttcaggatctatgccttatcaaccaaattgttttgcctatccaccccatggtgccaaacccatatactctcctatcctcaatacctccctccacaatccattattctgttctggatctcaaacatgctttctttactattcctttgcacccatcatcccagcctctcttcgttttcacttggactgaccctgacacccatcaggctcagcaaattacctgggctgtactgccgcaaggcttcacagacagcccccattacttcagtcaagcccaaatttcatcctcatctgttacctatcttggcataattctcataaaaacacacgtgctttccctgctgatcatgtctgattaatctcccaaacctcaatcccttacaaaacaacaactcctttccttcctaggcatggttagtgtggtcagaaatcttacacaagagccaggaccgcaccctgtagcctttctgtgcaaacaacttgaccttactgttttagcctagccctcatgtctgcctgcagcggctgctgctgttttaatacttttagaggccctaaaaatcacaaactatgctcaactcactctctacatttctcataacttccaaaatctattttcttcctcatacctgacgcatatactttctgctccccggctccttcagctgtactcactctttattaagtcccacaattaccattgttcctggcccggacttcaatctggcctcccacattattcctgataccacacctgacccccatgactgtatctctctgatccacctgatattcaccccatttccacatatttccttctttcctgttcctcaccctgatcacgctttatttattgatggcagttccaccaggcctaatcgccacacaccagcaaaggcaggctatgctatagtacaagtcactagcccgcctcttagaacctctcatttcctttccaccgtagaaatctatcctcaaggaaataacttctcagtgttccatctgctattctactactcctcagggattattcaggccccctcccttccctacacatcaagctcaaggatttgcccccatccaggactggcaaattagctttactcaacatgccccgagtcagataactaaaatacctcttagtctaggtagacactttcactggataggtacaggcctttcctacagggtctgagaaggccaccacagtcatttcttcccttctgtcagacataattcctcagtttagccttcccacctctatacagtctgataacagaccagcctttattagtcaaatcagccaagcagtttttcaggctcttagtattcagtgaaacctttatattccttatggtcctccgtcttcaggaaaagtagaacggactaaaggtcttttaaaaacacaccttcccaagctcagccaccaacttaaaaaggactggacaatacttttaccactttcccttctcagaagtcagacctgtcctcagaatgctacaaggtactgcccatttgagctcctgtatagacattcctttttattaggccccagtctcattccagacgccagaccaacttagactgtgccccaaaaaaacttgtcatccctactaacttctgtctagtcatactcctattcaccattctcaactactcatacatgccctgctcttgtttacactgccggtttacgctgtttctccaagccatcacagctgatatctcctggtgctatccccaaactgccactcttaactcctgaagtaaataaataatctttgctggcaggactatgctgaatctccttaggcactctctaatcagatgtcctgggtcatcccaattcttagaccttttatacctgtttttctccttctgttattccatttagtttttcaattcatacaaaactgtatccaggccattaccaataattctacatgacaaatgtttcttctaacaaccccacaatgtcaccccttaccacaaaatcttccttcagcttaatctctcccactctaggttcccacaccacccctaatcccgctcgaagcagccctaagaaacatcgcccactatctctccatactatcccccaaaattttcactatcccaacactttaccactatttcgttttatttttcttattaatataagaagacaggaatgtcaggcctctgagcccaagctaagccatcatatcccctgtgacctgcacgtacacaaccagatggccggttcctgccttaactgatgacattccaccacaaaagaaatgaaaatggcctgttcctgccttaactgataacattgtcttgtgaaattccttctcccggctcatcctggctcaaaagctcccctactgagcaccttgtgacccccactcctgcccgccagagaacaacccccctttgactgtaattttcctttacctactcaaatcttataaaacggccacacccctatctctcttcactgactctcttttcggactcagcctgcctgcacccaggtgattaaaagctttattgctcacacaaagcctgtttggtggtctcttcacacggatgcccatgaaa

SEQ ID NO: 147 - DNA, 429 bp, Homo sapiens
gtcaggcctctgagcccaagctaagccatcgtatcccctgtgacctgcacgtatatgtccacatggcctgaagcaagtaaagaatcacaaaagaagtgaaaatggccggttcctgccttcactgatgacattccaccactgtgatttgttcctgccccaccttaactgagcaattaaccttgttaaattccttctcctggctcagaagctcccccactgagcaccttgtgacccgcccctgcccgtaagagaaaaaccccctttgattgtaattttccactacccacccaaatcctataaaacagccccaccctaggtcccttcgctgactctcttttcggactcagcccacctgcacccaggtgaaataaacagccttgttgctcacacaaagcctgtttggtggtctcttcacatggacgcgcgtga

SEQ ID NO: 148 - DNA, 6120 bp, Homo sapiens
gtcaggcctctgagcccaagccaagccatcgcatcccctgtgacttgcacgtattcgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcgacccccactccggcccaccagagaacaaaccccctttgactgtaattttcctttacctacacaaatcctataaaatgaccccatccttatctcctttcgctgactgtcttttcagactcagcccacctacacccaggtgaaataaacagccatgttgctcacacaaagcctgtttggtggtctcttcacacggatgcacatgaaatttggtgccatgactcagatcgggggacctcccttaggagatcaatcccctggcctcctgttctttgctccatgagaaagatccacctacgacctcaggtcctcagactgaccagcccaagaaacatctcaccaatttcaaatccagtaagcggcctctttttactctcttctccaacctccctcactatccctcaacctctttctcctttcaatcttggcaccactcttcaatctctccgttctcttaatttcaattcctttcattttctaggagagacaaaggagacacgttttatccgtggacccaaaactccggcgccggtcacggactgggaaggcagccttcccttggtgtttaatcattgcagggacacctctctgattattcacccatgtttcaaaggtgtcagaccatggagggatgcctgccttggtccttcacccttagcggcaagtccagcttttctaggaaaggggcaagtaccccaaccccttctttccttgtctctaccccttctctgcttttctgggggaggggcaagtacccctcaaccccttctccttcacccttagcggcaagtcccgcttttctgggggaggggcaagtacccctcaaccccttctccttcactcttagtggcaagtcccgctcttctagagcaggggcaagtaccccaacctcatatctctgtgccccagtcccttatttccacgccccaacctcttatatctctgcaccccaatcccttatttccatgccccaacctcttatctctgtgccccaatcccttatttccatgccccgaccccttatttctgtgccccatcccttatttctgtgccccaacctcttatctctgtgccccaaccccttttcccacttttctggaaggtaagaacccccgaaccccttccctccgtttctctactctcttttctctaggcttgcttccttcactatgggcaactttccaccctccattcctccttctactcccttggcctgtgttctcaaaaacttaaaacctcttcaactcacacctgacctaaaacctaaatgccttattttcttctgcaatgctgcttgactccaatacaaactcgagagtagttccacatagccagaaaatggcactttgaatttttccatcctgcaaaatctaaataattattgtcgtaaaataggcaaacggtctgaggtgcctgaagtccaggcattcttttacacatcagtcccttcctagtctctgtgcccagtgcaactcatcccaaatgttccttctttccctcccatctgtcccctcagtaccaaccccaagcgtcactgagtctttctaatcttccttttgtacagacccatctgacctctcccttcctccccaggctgctcctcgccaggccgagctaggtcccaattcttcctcagcctccgttcctccacgctgtaatctttttatcacctcccctcctcacacctggtccggcttacagtttcgttctgtgactagccctcccccacctgcccagcaatttactcttaaaaaggcggctggagccaaaggcatagtcagggttaatgctcctctttctttatcccaaatcagaagcgtttaggctctttttcatcaaatataaaaatccagcccagttcatggctcgtttggcagcaaccctgagccactttacagccctagaccctaaaaggtcaaaaggccgtcttattctcaaaatacattttattacccaatctgctcctgacattaaataaaactccaaaaattaaattctggccctcaaaccccacaacaggatttaattaacctcgccttcaaggtgtacaataatagaaaaaatttgcaattccttgccttcactgtgagacaaaccccagccacatctccagcacacaagaacttccaaacgcctgaaacgcagtggccaggcattcctccagaacctcctcccacagagcttgctacacgtgctggaaatctggacactgggccaaggaatgcccacagcctgggattcctcctaagccgtgtcccatctgtgcgggaccccactggaaatcggactgttcaactcacctggcagccactcccagagcccctggaactctggcccaaggctctctgactgactccttcccagatcttctcagcttagcagctgaagactgacactgcctaatctcctcggaagccccctagaccatcatggacgccgagcttcaggtaactctcacagtggaaggtaagcccatccccttcttaatcaatatggagggtacccactccacattacctccttttcaaaggcctgtttcccctgcctccgtaactgttgtgggtattgatggctaggcttctaaacctcttaaaactccccaactctggtgccaacttagacaatactcttttaagcactcctttttagttacccccacctgcccagttcccttattaggctgagacactttaactaaattatctgcttccctgactattcctggactacagctatatctcattgccacccttcttcccaatccaaagcctcctttgtgtcctcctcttgtatcccccgaccttaacccacaagtataagatacctctactccctccttggtgaccaatcatgcaccccttaccatttcattaaaacctaatcacccttaccccactcaacgccaatatcccatcccgcagcacgctttaaaaagattaaagcctgttatcactcacctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctacaacccattattctgttctagatctcaaacatgctttcttcactattcctttgcacccttaatcacagcctctcttcgctttcacttggactgaccctgacacccatcaagctcagcaaattacctaggctgtactgccacaaagcttcacagacagcccccattacttcaatcaagcccaaatttcttcctcatctgttacctatctcagcataattctcataaaagcacacatgctctccctgccaatcgtgtctgactgatctctcaaaccccaaccccttctacaaaacaactcctttcattcctgggcatggttggatactttcgcctttggatacctggttttgccatcctaacaaaaccattatataaactcacaaaagaaaacctagctgatcccatagatcctaaatccttttcccactcctctttctgttccttgaagacagctttagaaactgcccccactctagctctccctgactcatcccaacccttttcattacacacagccgaagtgcagggctgtgcagtcagaattcttacataaggaccaggatcgcatcctgtagcctttttgtccaaacaacttgaccttacagttttaggctggccatcatgtctccgtgcagctgctgctgcttccctaatacttttggaggccctcaaaatcacaaactatgctcaactcactctctacagttctcaacttccaaaatctattttcttcctcatacctgatgcatatactttctgctccctggctccttcagctgtactcactctttgttgagtctcccacaattaccgttgttcctggcccagacttcaatctggcctcccacattattcctgataccacacccgacccccatgactgcatctctctgatccacctgacattcaccccatttccccaaatttccttctttcctgttcctcaccctgatcacacttgatttattgatggtggttccaccaggcctaatcgccacacgccagcaaaggtaggctatgctatagtacaagccactagcctgcctcttagaacctctcatttcctttccattgtggaaatctatcctcaaggtaataacttctcagtgttccatctgctgttctactactcctcagggattattcaggccccctcccttccctacacatcaagctcgaggatttgccccacccaggactggcaaattagctttattcaacatgccctgagtcagataactaaaatacctcttagtctaggtagatactttcactggataggtagaggcctctcctacagggtctgagaaggccaccgcagtcatttcttcccttctgtcagacataattcctcagtttagccttcccacctcaatacagtctgataacagatgagcctttattagtcaaatcagccaagcagtttttcaggctcttagtgttcagtgaaacctttatgtcccttacggtcctccgtcttcaagaaaggtagaatgaactaaaggtcttttaagaacacacctcaccaagctcagccaccaacttaaaaaggactggacaatacttttatcactttcccttctcagaattcaggcctgtcctcggaatgctacagggtacaacccatttaagctcctgtatagacgctcctttttattaggccccagtctcattccagacaccagaccaacttagactgtgccccaaaaaacctgtcatccctactatcttctgtctagtcatactcctatttaccattctcaactactcatacaggccctgctcctgtttacactgctggtttacactgtttttccaagccatcacagctgatatctcctggtgctatccccagactgccactcttaactcttgaagtaaataaataatcttttctggcaggactatgctgaatctccttaagcactctctaatcagatatcctgagtagtcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaatctctcccactctaggctcccacgccgcccctaatcccgcttgaagcagccctgagaaacatcgcccattctctctccataccatcccccaaaaatttttgccacaccaacacttcaacactatttcattttatttttcttattaatataagaagtcaggaatgtcaggcctctgagcccaagccaagccatcgcatcccctgtgacttgcacgtatatacccagatggcctgaagtaactgaagaatcacaaaagaagtgaatatgccctgccccaccttaactgatgacattccaccacaaaaaaagtataaatggtcggtccttgccttaagtgatggcattaccttgtgaaagtccttttcctggctcatcctggctcaaaaacacccccactgagcaccttgcgacccccactcctgcccgccagagaacaaaccccctttgactgtgattttcctttacctactcaaatcctataaaagggccccacccttatctcccttcgctgactctcttttcagactcagcccgcctgcacccaggtgaaataaacagacatgttgctcacacaaagcctgtttggtgggcttttcacacggacgcgcatgaaa

SEQ ID NO: 149 - DNA, 2754 bp, Homo sapiens
tggatcaggtgcaaagtaagcccaccccactgagaactatgttaaagaatttcaagaaaggatttaatggagactatggagtcactatgactccaggaaaacttagagctttgtgtgaaatagactggccagcattagaggtaggttggacatcagaaggaagcctggacaggtcccttgtttcaaaggtatgacacaaagtaacctgtaaaccaaggcaccaagaccagtttccatacatagacagttacagctgtctttagaccccttcccccccaacagtagttaagagaacagcagcataagcagctggcagaggcaaggaaagaccagcagagagaaaaaaaaggccatctataccaattctaagttaatttagactaaacaaggtcttattaatagcaaaggataattgaaatcccaaacttacaaggttttcaacaaaagtgaagtttgctaaaagttaacagtgtaacacatattatggtaaattctaatcttgtggccttagacagtctagtccaaagacatcaaaaaagtttgcttaaaaaaaaagaaatggttatcttcaaaaaaaaaaaaaaaaaaaaaaagaaggggaggcaaaatttacgtaaaaagagtgttatatggtaaattcttgttctgaaataaattggttgtttcaagaaaaaaatgtttgtaataagtcaaaaagttgagacatgttgaagaattgtcagtggaagtcgtgaaaaaaagttataaaaatttatgcaaaaaggttttataatttaaaagtaatttggcctcttgagtactattgaagaaacagtttatgtgcaaagtgtataaaaaagtaaaacatacctttggtaaaaagattataaggaggcataaaaatgtggatttttacctacattaaaaggttaaaaaaattattgttttaaaagtttaagcaagttttaaaacattaattgtaaagaaaagtctgtgtgtaaacatattagctaaagttaaaaagatatcatccagtttttctgcgaactagacataaaagtaaaaatgcaacaggttttttttcttaaagcatcaacctgctctttaacaaaaattataaaaggttaaaaagagtctataaaatcttaccttatggtcaaacatgaaaaattagataaatatgtcttcaaggttttattaaaattaagtttaatattaatagcatactaatataaaggtaaaatttagcttatctggtataaaaatcatacaagaagcattattaaatatgaaatggtgtttagctttctttggtctaaaaactaatacaaattggtgctaaaggaaacattcattttactagaagatcacagaagttaaagacttaaaaaaaactttggcaattaagacagcataccaagatgcaaatgcctggttgaaatagatcaaatattccatctgcacgttaaacaaaagcaattgttatgcttgtgcacatggcaggccagaggccctaattgtcccctttccactacagtggtcctccagttgaccaggcgtaggctgcatggtaactcttttccaggattctacagcctggagtaataagtcatgccaagctctctctgctatatcctgaagtccctgtgggtcagcctccgagggccatccagcttccatctcccaacactaagttcacttcgtgtctctcacagcagggaggagacagcattccttagagacctgaaaggatgcagtgagcttaagaattttcgaaaggttatcaatcagtcagccgttgttcatccccgagcagatgtgtggtggtattgtggtggacctttactaggtactctgctgaataagtagagtggcacttgtgctttagtccatttggctatccctttcatcctggcatttcatcaaccagaggaagaaaagaaaataataagatatcataaagcgagagaagccccttataggtcttccaactctcatatctatttagatgcaattagagccccgcaaggaataccagatcaatttaaagcttgaaatcaaatagctacaggatttaagtcaatattttggtagatgacagtgaataaaaatgtagattagataaactacatctattacaaccaacagcaaagagcttttcatgagttaaaaaaaaaaaaactcatgtcggccccagccctgaggttacctgacctgactctgtgaagtctgtgtgtcagaaaagaaaaaaatggcagttggagttttaactcagactgtggggcactggccaaggccagtggcctatctctcaaaacaaaaagacagggtttccaaaggctggcccccatgtccaagggccctggcagcaatggccctgttaccacaagaagcagataagctaactcttagacaaaacctaaacataaagtctccccatgctgtggtgattttaataaatactaaaggacaccattagctaataaatgttacactaagtagataccaaagcttgctctgtgaaaatccccacataaccattgaagtttgcaacaccctaaccctgccaccttactcctggtatcagagagcctagttaaacataactgtttagaggtgctggactcagtttattctagtaggcccaacctccgagacaatccttaaccatcagtagactaggagttgtatgtagataggagcagcgtcaccaacccctgcaaagtgactctgaagaagactacaagccctgctccagtcacacccagaagctga

SEQ ID NO: 150 - DNA, 71 bp, Homo sapiens
tggctgactcttttcggactcagcccgcctgcgcacccaggtgaaataaacagccatgttgctcacaaaaa

SEQ ID NO: 151 - DNA, 497 bp, Homo sapiens
atggaatgagaccaccacttctcctgttgtccttcccagcttctcccctacctcctcttttccctagtttataagacaggagaaaagggagaaagcaaaaagttggaaagaaacagaagtaagataaatagctagatgaccttggcgccaccatctggccctggtggttaaaataataataataatattaacccctgatcaaaattacttgtgttatctgtaaattccagacattgtatgagaaagcactgtaaaactttttgttctgttaggtgatgcatgtagcccccagtcacgttcctcatgcttgcttgatctattatgaccctttcacgtggatcccttagagttgtaagcccttaaaagggctaggaatttctttttcggagagctcagctcttaagatgagactctgccaactcttccagccgaataaaaacctcttccttctttaatctggtgtctgaggagttttgtctggggcttgtccggctaca

SEQ ID NO: 152 - DNA, 4053 bp, Homo sapiens
gtcaggcctctgagcccaagccaagccatcgcatcccctgtgacatgcgcgtatacatccagatggcctggagtaactgaagatccacaaaagaagtgaaaatagccttaactgatgacattccactattgtgatttgttcctgccccaccataactgatcaatgtactttgtaatctcccccacccttaagaaggttctttgtaattctccccacccttgagaatgtactttgtgagatccacccctgcccacaaaacattgctcttaacttcaccgcctatcccaaaacctgtaagaactaatgataatccatctcccttcgctgactctcttttcggactcagcccgcctgcacccaggtgaaataaacagccatgttgctcacacaaagcctgtttggtggtctcttcacacggacgtgcatgaaatttggtaccatgactcggttcggaggacctcccttgggagatcaatcccctgtcctccttgctctttgctgcatgagaaagatccatctatgtatgacctcaggtcctcagatggaccagcccaagaaacatctcaccaatttcaaatccagtaagtagcctctttttactctcttctccaaattccctcactatccctcaacctctttctcctttcaatcttggtgccacacttcaatctctcccttctcttaatttcaattcctttcattttctggtagagacaaaggagacacgttttatccgtggacccaaaactccggcaccggtcacggactgggaaggcagccttcccttggtgtttaatcattgcagggacatctctctgattattcacccacgtttcaaaggtgtcagaccacgcagggacgcctgccttggtccttcacccttagcggcaagtcccgcttttctgggggaggggcaagtaccccaaccccttctctctgtgtctctaccccttctctggttttctgggggaggggcacataccccaaccccttctcttcatgtctctaccccttctctggttttctgggggaggggcaagtaccccaaacccttctctccgtgtctctaccccttctctgctcttctggggcaggggcaagaacccctcaaccccttctccttcacccttagtggcaagtcccgcttttctagagggcaagaacccccaatcccttatttccgtgccccaacaccttctctgcttttctggagggcaagaaccccctaccccttctccgtgtctctactcttttctctgggcttgcctccttcactatgggcaagcttccaccttccattcctcctccttctcccttagcctgtgttcttaagaacttaaaacctcttcaactctcacctgacctaaaatctaagcatcttattttcttctgcaatgccgcttgaccccaatacaaactcgacagtagttccaaatagccagaaaacggcactttcaatttttccatcctacaagatctaaataattcttgtcataaaatgggcaaatggtctgagatgcctgacatccaggcattcttttacacatcagtcccttcctagtctctgtgcccaatgcaactcatcccaaatcttccttctttccctcttgcctgtcccctcagtcccaacgtcaagcgtcactgcgtctttctaatcttccttttctacagacccatctgacctctcccctcctccccaggctgctcctcgccaggccaagctaggtcccaattcttcttcagcttctgctcctccactctataatccatttatcacctcccctcctcacacctggtccggcttatggtttcattctgtgactagccctcccccacctgcccagcaatttactcttaaaaaggtggctggagctaaaggcatagtcaaggttaatgctcctttttctttatcccaaatcaggtagcctttaggctctttttcatcaaatataaaaacccagcccagttcatggctcgtttggcagcaaccctgagaagctttacagccctagaccctaaaaggtcaaagggccgtcttattcttaatatacattttattacccaatctgctcctgacattaaataaaactccaaaaattaaattccggccctcaaaccccacaacaggatttaaccttgccttcaaggtgtacaataatagaaaaaagttggaattccttgcctccactgtgagacaaaccccagcaacatctccagcacacaagaacttccaaacacctaaacagcagtggccaggtgttcctccagaactgcctcccccaggagcttgctacaagtgccagaaatctggccaccgagccaaggaatgcccgcagcccgggattcctcctaagccgtgtcccatctgtgtgggaccccactgaaaatcggactgttcaactcacctggcagcccctcccagagcccctggaactctggcccaaggctctctgactgactccttcccagatcttctcggcttaatggctgaagactgacgctgcccgatcgccttggaagccccgtagaccatcatggacaccgagctttaggtaactctcacagtggaaggtaagtccgtcctcttcttaatcaatacggaggctacccactccacattaccttcttttcaagggcctgtttcccttgcctccataactgttgtgggtattgacggccaggcttctaaacctcttaaaactccccaactctggtgtcaacttagacaatactcttttaagcactcctcttaattatccccacctgccccgttcccttattaggccgagacactttaactaaattatctgcttccctgactattcctggattacagttacatctcattgctgcccttctttccaatccaaagcctcctttgtgtcctcctcttgtatcccccgaccttaacccacaagatacctctactccctccttggcgacctatcatgcaccccttaccatctcattaaaacctaatcatccttaccccgctcaatgccaatatcccatcccacagcatgctttgaaaggattaaagcctgttatcacttgcctgctacagcatggccttttaaagcctataaactctccttacaattcccccattttacctgtcctaaaaccagacaagccttacaagttagttcaggatctatgccttatcaaccaaattgttttgcctatccaccccatggtgccaaacccatatactctcctatcctcaatacctccctctactacccattattctgttctggatctcaaacatgctttctttactattcctttgcacccgtcatcccagcctctctttgcttttacttggactgaccctgacacccatcagactcagcaaattacctgggctgtactgccacaaagcttcacagacagcccccattacttcagtcaagcccaaatttcttccttatctgttacctatctcagcataattctcataaaaacacacattctctccctgctgatcatgtccgattaatctcccaaacctcaatcccttctaaaaaacaagaactcttttccttcctgggcatggttagtgcggccagaattcttacacaagagccaggaccacaccgtgtagcctttctgtccaaacaacttgaccttactgttttagcctagccctcatgtctgcgtgcagcggctgccgctgcttgaatacttttagaggccctaaaaatcacaaactatgctcaactcactctctacatttctcataacttccaaaatctattttcttcctcatacctgacgcatatactccctggctccttcagctgtacttactctttgttaagtcccacaattaccattgttcctggcccggacttcaatctggcctcccacattattcctgataccacacctgacctccatgactgtatgtctctgatccaactgacattcaccccatttccccatatttccttctttccttttcctcaccctgatcacgcttgatttattgatggcagttccaccaggcctaatcaccacacaccagcaaaggcaggctatgcgatagca

SEQ ID NO: 153 - DNA, 662 bp, Homo sapiens
ttacagtaggtagttagacagacatgaggcagggaaggccaccctccccacaatgaggaatgtcaggcaaccatcaggtgatggtcaggcagttgttaattgtctctctaaaataatcattggttgaagccagggccaggcagtttcccaataaatagaaaacacctgaaactggtgatcagcttcctagtaagatctcaggagttgggtgagtggactcaagcatgcgcactaagaggcaaaatggcagagtttaactggtatatgaatcctcaactgataaggagaaaaagccctcaagtgagcacgtacacaacttcagtaaacacactgcgcacgctcaccccccaagtgcctgaatgccactgtggatgcggacagcccactccaagggaagaatcaggggagaagagatgcaacccccctggaagcatgccaacatatgaaacaccaagtcaaaggtcaaaccacccggctgatctcaagtcacccgcttggccctcttctaagtgtacttccttttgttcctgctctaaagctttttaatacacttttcactcctgctcaaaaacttgccttggcctctcaccctgccttatgacccttggttaaaaattctttcttttgaggtgttaagaattgaggttgctacagatttgcca

SEQ ID NO: 154 - DNA, 1924 bp, Homo sapiens
accatcctattaaaacctaatcactcttaccctgctcaatgccaatatcttatcctatagcatgctttgaaagaattaaagcctgttatcattcacctgttacagcatggccttttaaagcttataaactcttcttgacattcacctcatttccccatatttccttctttcctcttcctcgccttgatcatgcttgatttattgatggcagttccaccaggcctaattgccacaccagcaaaggcaggctatgctatagtacaagccactatcccacctcttagaacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattagctttactcaacatgtcccgagtcagataactaaaatacctcttagtttaggtagacactttcactggataggtagaggcctttcctacagggtctgagaaggccaccgcagtcatttcttcctttctgtcagacataattcctcagtttagccttcccaccactatacagtctgataacagaccagcctttattagtcaaatcagccaagcagtttttcaggctcttagtattcagtgaaacctttatcccttatggtcctccgtcttcaagaaaagtagaatggactaaatgtcttttaaaaacacacctcaccaagctcagccaacaacttaaaaaggactggacaatacttttaccactttcgcttctcagaagtcagacctgtcctcaggatgctacagtgtacagcccatttgagctcctgtatagatgctcctttttattaggccccagtctcattccagacaccagaccaacttagactgtgcccccaaaaaacttgtcatccctactatcttctatctagtcatactcctattcactgttctcaactactcatacatgccctactcttgtttacactgccagtttgcattatttctccaagccatcacagctgatatctcctggtgctatccccatactgccactctaaactcttgaagtaaataaataatctgctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaataattctacaccacaaatatttcttctaacaactccacaatatcaccttttaccacaaaatcttccttcagcttaatctctcccactctaggttcccacgccacccctaatcctgctcgaagtagccctgagaaacattgcccattatctctccataccacctccaaaaattttcaccatcccaacactttaccactatttcattttatttttcttattaatataagaagacaggaatgtcaggcctctgagcccaagctaagccatcataccccctgtgacctgcatgtacacatccagaaggccagttcctgccttaactgatgacattccaccacaaaagaagtgaaaatggcctgttcctgccttaactgatgacattgtcttgtgaaattccttctcctggctcatcctggctcaaaagctcccctactgagcaccttgtgaccccaactctgcccgccagagaacaacccccctttgactgtaattttcctttatctccccaaatcctataagacagctccacccttatctcccttcgcagagtctcttttcggattcagcccgcctgctctcgggtgattaaaagctttattgctcacacaaagcctgtttggtggtctcttcacatggaggtgcatgaaa

SEQ ID NO: 155 - DNA, 353 bp, Homo sapiens
ccacaaaagaagtgaaaatagtcagttcctgccttaactgatgacacaccaccactgtgatttgttcctgccccactctaactgatcaatggaccttgtgacattccttctcctggacaatgaatctcaggagctccccagtgagcaccttgtgacccccacccctgcccgcaagagaaaaacccccattaactgtaattttccactacctacccaaatcctataaaactgccccacccctacctccctttgctgactcctttttcactcagtccacctgcacccaggagattaaaaagctttattgctcacacaaagcctgtttggtggtctcttcacatggacacacgtaa

SEQ ID NO: 156 - DNA, 6026 bp, Homo sapiens
gtcaggcctctgagcccaagccaagccatcgcatccactgtgacttgcacatatacacccagatggcctgaagtaactgaagaatcacaaaagaagtgaacatgccctgccccaccttaactgatgacattccaccacaaaagaagtgtgaatggcgggtccttgccttaactgatgacattaccttgtgaaagtccttttcctagctcatcctgcctcaaaaagcacccccactgagcaccttgcgacccccactcctgcctgccagagaacaaaccctctttgactgtaattttcctttacctacccaaatcctataaaacggccccacccttatctcccttcactgactctcttttcggactcagcccgcctgcacccaggtgaaataaacagccacattgctcacacaaagcctgtttggtggtctcttcacacagacgcgcatgaaatttggtgccatgactcagattgggggacctcccttgggagatcaatcccctgtattcctgttctttgctccgtgagaaagatccacctatgacctcaggtcctcagaccaaccagcccaaggaacatctcaccaattttaaatcaggtaagcagcctcttcttactctcttctccaacctccctcactgtccctcaaccactttctcctttccaatcttcaatctctcccttctcttaatttcaattcttttcattttctgggagagacaaaggagacatgttttatccatggacccaaaactccggcgccagtcatggactgggaaggcagccttcccttggtgtttaatcattgcagggatgcctctctgattatacacccacgtttcaagggtgtcagaccacgcaggtacacctgccttggtccttcacccttagcagcaagttccgcttttctgggggaaggggaaagtacctcaatcccttctctccttgtctctaccccttctctgcttttccggggacaggacaagtaccccaaccccttctctccttgtctctaccccttctctgcttttctgggagaggggcaagtatccctcaaccccttctccttcactcttagctgcaagtcctgcttttctagaggaggggcaagtaccccaaccttgtatctctgtgccccgaccccttatttccatgccccgacaccttatttctgcaccccattccttatttccacacgctgacctctcatctctgcaccccaaccccttttcccacttttctggaaggtaagaacccccaaaccccttccctccatttctctactctctcttttctctaggcttgcttccttcactatgggcaactttccaccctccattcctccttctactcccttggcctgtgttctcaaaaacttaaaacctcttcaactcacacctgatctaaaacctaaatgacttttcttcttcaatgctgcttgaccccaatacaaactcgacagtagttccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgcccagtgcaactcatcccaaatcttccttctttccctcccgcctgtcccctcagtaccaaccccaagtgtggctgagtctttctaatcttccttttctacagacccatcagacctctcccttcctccccaggctgctcctcgccaggccgagctaggtcccaattcttcctcagcctctgctcctccaccctataatctttttatcacctcccctcctcacacctggtcctgcttacagcttcgttccctgactagccctccccctcctgcccagcaatttactcttaaaaaggtggctggagccaaaggcatagtcaaggttaatgctcctttttctttatcccaaatcagaagcgtttaggctctttttcatcaaatataaaaacccagcccagttcatgacttgtttggcagcaaccctgagacgctttacagccctagaccctaaaaggtcaaaaggccgtcttattctcaatatacattttattacccaatctgctcccgacattaaataaaactccaaaaattggaatctggccctcaaaccccaaaacaggacttaattaacctcaccttcaaggtgtacaataacagaaaaaagttgcaattccttgcatccactgtgagacaaaccccagccacatctccagcacacaagaacttccaaacgcctgaaccgcagcagccaggcgttcctccagaacctcctcccatatgagcttgctacacatgccggaaatctggccactggaccaaggaatgcccgcagcccaggattcctcctaagccacgtcccatctgtgtgggaccccactgaaaatcgcactgttcaactcacctggcagccactcccagagcccctggaactctggcccaaggctctctgactgactccttcccaggtcttctcggcttagcggctgaagactgacactgcctgatcgccttggaagccccctagaccatcacggacgccgagcttcgggtaactcttacagtggaaggtaagcccatccccttaatcaatatggaggctacccactgcatattaccttcttttcaagggcctgtttcccttgcctccataactgttgtgggtattgacggctaggcttctaaacctcttaaaactccccaactctggtggcaacttagacaatactcttttaagcactcctttttagttatccccacctgcccagttcccttattaggctgagacactttaaattatctgcttccctgactattcctggactacagctatatctcattgccacccttcttcccaatccaaagcctcctttgcgtcctcctcttgtattcccccaccttaacccacaagtataacccacctctactccctccttagtgaccgatcatgcaccccttaccatctcattaaaacctaatcactcttaccccgctaaacgccaatatcccatcccacagcacgctttaaaaagattaaagcctgttatcactcacctgctacagcatggccttttaaagcctataaactctccttacaactcccccattttacctgtcctaaaaccggacaagccttacaagttagttcaggatctgcgccttatcaaccaaattgttttgcctatccacccacggtgccaaacccatatactctcctatcctcaatatctgcctctacaacccattattctgttctaaatctcaaacatgcttttttcactattcctttgcccccttaatcccagcctctcttcgctttcacttggactgaccctgacacgcatcaagctcagcaaattacgtaggctgtactgccgcaaagctttacagacagcccccattacttcaatcaagcccaaatttcttcctcatctgttacctatctcggcataattcccataaaaacacacgtgctctccctgctgaccatgtccgactaatctctcaaaccccaaccccttctacaaaacaacaactcctttccttcctgggcatggttagatactttcgcctttggatacctggttttgccatcctaacaaaaccattatataaactcacaaaaggaaacctagctgaccccatagatcctaaatcctttccccactcctctttctgttccttgaagacagctttagaaactgctcccactctagctctccctgactcatcccaaaccttttcattacacacagctgaagtgcagggctgtgcagtcggaattcttacacaaggaccaggatcgcatcctgtagcctttttgtccaaacaacttgaccttactgttttaggctggccatcatgtctccatgcagcagctaccgctgctttaatacttttagaggccctcaaaatcacaaactatgctcaactcactctctacagttctcataacttccaaaatctattttcttcctcatacctgacgcatatactttctgcttcccggctccttcagctatactctttgttgagtctcccacaattactgttgttcctggcccagacttcaatccggcctcctacattattcctgataccacacctgagccccatgactgcatctctctgatccacctgacattcaccccatttccccaaatttccctctttcctgttcctcagcctgatcacgcttgatttattgatggcggttccaccaggcctaatcgccacacaccagcaaaggcaggttatgctatagtacaagccactagcccacatcttagaacctctcatttcctttccattgtggaaatctatcctcaaggaaataacttctcagtgttccatctgctattctactactcctcagggatagttcaggccccctcccttccctacacatcaagctcaaggatttgcccccacccaggactggcaaattagctttactcaacatgcccgagtcaggaaactaaaatacctcttagtctaaatggacactttcactgaataagtaaaggcctttcctacagggtctgagaaggccaccacagtcatttcttcctttctgtcagacataattactcagtttagccttcccacctcaatacagtctgataacagacgagcctttattagtcaaatcagccaagcagtttttcaggctcttagtattcagtgaaacctttatatcccttatggtcctccgtctttaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagacgctcctttttattaggccccagtctcattccagacaccagaccaacttagattgtgccccacccccccaaaaaaaaaattgtcatccctactattttctgtctagtcatactcctattcaccattctcaactactcatacatgccttgctcttgtttacactgccggtttacactgtttttccaagccatcacagctgatatctcctggtgctatccccaaactgccattcttaactcttgaagtaaataaataatctttgctggcaggactatgccgaatctccttaagcactctctaatcagatatcctgagtcgtcccaattcttagaccttttatacctgtttttcttcttctgttattccatttagtttttcaattcatacaaaaccgtatccaggccgtcaccaatcattctatatgacaaatgtttcttctaacatccccacaatatcacgccttaccacaagacctcccttcagcttaatctctcccactctaggttcccacatcgcccctaatcccgcatgaagcagccctgagaaacatcgtccattctctctccataccaccaccccaaaattttcactgccccaacacttcaacactattttgttttatttttcttattaatacaagaaggcaggaatgtcaggcctctgagcccaagccaagccatcgcatcccctctgacttgcacgtatatgcccagctggcctgaagtaactgaagaatcacaaaagaagtgaacatgccctgccccaccttaactgatgacattccaccacaaaagaagtgtgaatggcgggtccttgccttaagtgatgatattaccttgtgaaagtccttttcctggctcatcctggctcaaaaacacccccactgagcaccttgcgaccccccactcctgcccgccagagaacaaaccccctttgactgtaattttcctttacctacccaaatcctataaaacggccccacccttatctcccttcactgactgtctttttggactcagcctgcctgcacccaggtgaaataaacagccatgttgctcacacaaagcctatttggtggtctcttcacagggacgcgcataaaa

SEQ ID NO: 157 - DNA, 5642 bp, Homo sapiens
gtcaggcctctgagcccaagctaagccgtcatatcccctgtgacctgcacgtatacatccagatggcctgaaataactgaagaatcacaaagaagtgaaaatggcctgttcctgccttaactgataacattaccttgtgaaattccttctcctggctcttctggctcaaaagctcccccactgagcaccttgtgacccccacccctgccagccaaaaaacaaccccctttgactgtaattttccattacctacccaaatcctataaaacagccccacccctatctccttttgctgactcttttcggattcagcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccggtaagcagcctctttttactctcttctccaacctctctcactatctctcaacctctttctcctttcaatcttggcgccatctttcaatctctcccttcccttaatttcagttcctttccttttctggcagagacagaggagacgtgttttatccgtgaacccaaaactccagcgctggtcacagactcgggaagacagtcttcccttggtgtttaatcactgcggggatgcctgcttgattattcacccacatttcagaggtgtttgatcaccacggggacacctgccttgatccttcacccttagtggcaagcaccactaatttggggggcaagcacctcccttctctccgtgtctctaccctcccttttctctccactttcctggggggcaggcatcccccacaccttctctccatgtctctatcctctcttttctctgggcttacctccttcactatgggcaaacttccacccctccattcctccctcttctcccttagcctgtgttctcaagaatttaaaacctcttcaactcacacgtgacctaaaacctaaacatcttattttcttctgcaatgccacttaaccccaatacaaactcaacaatggttccaaatagccagaaaacggcactttcgatttctccatcctacaagatctagataattcttgtcataaaatgggcaaatggtctgaggtacctgacacccaggcattctttgttccctccctagtctatttccaatgcaattggtcccaaatcttcttttccctcccacctgtcccttcagtcccaaccccaagtgttgttgagtctttccaatcttccttttctaccgacccatctgacctctcccctcatccccagactgctcctcaggtcactccccagccaggctgaatcaggctccaattcttcctcagtttctgctcctccaccctataatccttctatcaccccctctccccaaacccagtccagcttacagtttcgttctgcaactagccctcccccatctgcccagtaatttcctcttaaaaaggtggctggagctaaaggcatagtcaaggttaatgctcctttttctttatccgaactctcccaaatcagttagtgtttaggctctttttcctcaaatataaaaacccagcccagttcatggctcatttggcagcaaccctgagacgctttacagccctagaccctgaagggtcagaaggctgtcttattctcaatatgcattttatcacccagtcagcccctgacattagaaaaaagcttcaaaaattagaatccggccctcaaacctcgcaatgggaattaatcaaccttgccttcaaggtgtacaataatagaaaggaggcagccagacagcaacacatttctgagttacaattacttgcctctgctgtgagacaaaacccagccgcatctccagcatacaagaacttcaaaacgcctgaactgcagcggccaggcattcctccaggaccacctgccccaggatcttgcttcaagtgctggaaatctggccactgggccaagtattgcctgcagcctgggattcctcctaagccatgtcccatctgtgcaggaccccactggaaactggactgtccaactcacccagcagccactcccagagcccctggaactctggcccaaggctatctgactgactccttcccagatcttctccgcttagcggctgaagactgatgctgcccaatcgcctcagaagcttcctggatcatcacagatgctttaggtaactcttacagtggagggtaagtccgtccccttcttaatcaatatggaggctaccaactccacattaccttcttttcaagggcctatttcctttgcctccacaactattgtgggtattgacagccaggcttctaaacctcttaaaacttcccaactctggtgccaacttggacaatattcttttatgcactcctttttagttatccccacctgcccagttcccttattaggtcaagacattttaactaaattatctgcttccctgactattcctgggctacagccacaccttattgccacccttttccccagtttaaagcctccttcacatcctccccttgtatctccccaccttaatccacacatatgggacatgtctactccctccttggtgactgatcatgcaccccttaccatcccattaaaacctaatcacccttaccctgttcaatgctaatatcctatcccacagcatgctttaaaaagattaaagcctgttatcacttgcctgttacagcatggccttttaaagcctataatctctccttataattcccccattttacctgttcaaaaaccagacaggtcttacaggttagtgcaggatctgtgccttatcaaccaaattgttttgcctatccaccccatggtgccaaactcatatatgctcctatcctccatacctccctccacaacccattattctgttctggatctcaaacatgctttctctactattcctttgcacccttcatcccagcctctcttcactttcacttggactgaccctgacacccatcaggctcagcaaattacctgggctgtactgctgcaagtcttcacggacaggccccattacttcagtgaaccccaatttcttcctcatccattacctatctcaacataattcttcatgaaaacacacatgctctccctgctgatcacgtccagctaatctcacaaaccctaaccccttctacaaagcaacaatgcctttccttcctaggcatggttagatactccacctttggatacctagttttaccatcctgactaaaccattatataaacttaaaaatgcaaacttagctgatcccatagatcctaaattctttcgccactcctctttctgttccttaaaaacagccctagaagctgctcccacactagctctctctaactcatccaaccctttttcattacacacagctgaagtgcagggctgtgcggtcagaattcttacacaagagccaggaccgcgcccggcagcctttctatccaaacaacttgaccttactgttttagcctagccctcatgtctgtgtacggcagctgtcgctgctttaatacttttagaggccctcaaaatcacaaactgtgctcaactcactctctccagttctcataacttccaaaatctattttcttcctcacacctgatgcatatactttctgccccgctccactacctctcagcaagctgaactcattgccttaactggagccctaacccttgcaaatgaattacacgtcaatatttatactgactctaaagatgccttccatatcctgcaccaccatgctgttgtatgggctgaaagaggtctcctcactacacaagggtcctccatcttaatgcctctttaataaaaactcttctcaaggccgctttacttccaaaggaagctggagtcattcactgcaagggccatcaaaaggcatcagatcccattgctctgggcaatgcttatgctgataaggtagctaaaaagcagctagcattccaacttctatccctcacagccagtttttctccttctcatcggtcactcccacctactcccctactaaaacttccacctatcaatctcttcccacacaaggcaaatggttcttagaccaaggaaaatatctccttccagcctcacaggcccattctattctgtcgtcatttcataacctcttccatgtaggttacaagccactagcccacctcttagaacctctcatttcctttccatcatggaaatctatccacaaggaaatcacttctcagggttccatctgctagtctactactcctcaggaccctcccttccctacacatcaagctcagggatttgcctctgcccaggactggcaaattgactttactcacatgccccaagtcaggaaactaaaatacctcttggtctaggtagacacgttcaccggttgggtagagacctttcccgtagggtctgaaaaggccaccacgatcatttcttcccttctgtcagacataattcctcggtttggccttcctacctctatacagtctgataacagaccagcctttattagtcaaatcactcaagcagtttctcaggctcttggtattcagtgaaaccttcataccccttaccgtcttcaatcttcaggaaaggtaaaacggactaatggtcttttaaaaacacacctcaccaaactcagcctccaacttaaaaaaaggactctgtcaagaatagagcccaaaaactcaccaaccaaacaagtaattacactgaatccccttgggcactctctaatcggatgtcctgggtcctcccaattcttagtcctttaatacctgtttttctccttctcttattcagaccttgtgtcttccatttagtttttcagttcatacaaaattgcatccaggccatcaccaatcattctacatgacaaatgctccttttaacaaccccacaatatcaccccttaccacaaaatcttcctttggcttaatctctcccactctaggttcccacactgcccttaatcctgcttgaagcagccctgagaaacattgcccattatctctccataccacccccaaaatttttgctgccccaacacttcaacactattttatgttatttttcttactaatataagaagacaggaatatcaggcctctgagcccaagctaagccatcatgtcccctgtgacctgcacgtatgcacccagatggcctgaagtaactgaaggatcacaaaagaagtgaaaacggcctgttcctgccttaactgatgacattaccttgtgaaattccttctcctggctcatcctggctcaaaagctcccccactgagcaccttgtgtcccctgcccgtgcctgccaaagaacaacccctttgactgtaattttccatgacctacccaaatcctataaaacggccccacccctatctcccttcgctgactctctttacggacttagcccacctgcacccaggtgattaaaaagctttattgctcacacaaagcctgttcagtggtctcttcacagggacacgcgtgaaa

SEQ ID NO: 158 - DNA, 5784 bp, Homo sapiens
gtcagacttctgagcccaagctaagccatcatatcccctgtgacctgcacgtacacatccagatcgctggttcctgccttaactgatgacattccaccacaaaagaagtgaaaatggcctgttcctgccttaactgatgacattgtcatgtgaaattccttctcctggctcatcccagctcaaaagctcctccactgagtaccttgtgaccccccactcctgcctgccagagaacaacacccctttttcctttacctacccaaatcctataaaacggccccacccctatctcccttcactgactcttttcggactcagcctgcctgcacccaggtgaaataaacagccacgttgctcacacaaagcctgtttggtggtctcttcacatggatgcgcatgaaatttggtgccgtgactcagatcgggggacctcccttgggagatcaatcccctgtcctcctgctttttgctccatgagaaatgtccacctacgacctcaggtcctcagaccgaccagcccaaggaacatctcaccaatttcaaatccggtaagaggcctctttttactctcttctccaacctccctcactatccctcaacctctttctcctttcagtcttggcaccacacttaatctctcccttctcttaatttcaattcctttcattttctggtagagacaaaggagacacattttatccatggacccaaaactccggcaccagtcatggactgggaaggcagccttcccttggtgtttaatcattgcagggacgcctctctgattattcacccatgtttcagaggtgtcagaccacgcagggatgcctgctttagtccttcacccttagcggcaagtcccgcttttctgtgggaggggcaagtaccccaaccccttctctccatgtctctaccccttctctgcctttctggggggcaagaaacccccaaccccttctccttcacccttagcagcaagtcctgcttttctaggggagggtcaagtaccacaaccccttatatctctgtgccccgatcccttatttccacaccccaacctcttatatctctgtgccccgatcccttatttccacaccccaacctcttatatctctgtgccccgatcccttatttctgcaccccaacctcttatatctctgtgccccaatcccttatttccacgccccaacctcttatatctctgtaccccaatcccttatttccacaccctgatgtcgtatctctgtgccccaaccccttctctgcttttctggagggcaagaataccccaccctttctctgtgtctctactgttttctctgggcttgcctccttcactatgggcaagcttccaccttgcccattcctccttcttctcccttagcctgtgttcttaagaacttaaaacctcttcaactctcacctgacctaaaatctaagcatttgattttcttctgcaatgccgcttgactccaatacaaactcgacagtagttccaaataaccggaaaacggcactttcaatttttccatcctacaagatctaaataattcttgtcataaaatgggcaaatggtctgaggtgcctgacatccaggcattcttttacacatcggtccctccctagtctctgtgcccaatggaactcgtcccaaatcttccttctttccctcccgcctgtcccctcagtcccaaccccaagcgtcactgagtctttctaatcttccttttctacagacccatctgacctctcccctcctccccaacctgctcctcgccaggccgagctaggtcccaattcttcctcagcctccgctcctccaccctataatccttttatcacctcccctcctcacacccggtctggtttacagtttcattccgtgagtagccctcccccacctgcccagcaatttcctcttaaaaaggtggctgaagctaaaggtatagtcaaggttaatgctcctttttctttattagacctctcccaaatcagtgagcatttaggctctttcatcaaatatgaaaaactcagcccagttcatggctcatttggcagcaaccctgagacactttacagccctagaccctaaaaggtcaaaaggccgtcttattctcaaaatacattttatcacctaatctgctcccgacattaaataaaactccaaaaattaaattccagccctcaaaccccacaacaggatttaattaaccttgccttcaaggtgtacaataatagaaaaaagttgcaattccttgcctccactgtgagaaaaaccccagccacatctccagcacacaagaacttccaaatgcctgaaccgcagcagccagaacctcctcccccaggagcttgctacaagtgccagaaatctggccaccaggccaaggaatgcctgctgcccaggattcctcctaagccgcgtcccatctgtgcaggaccccactggaaatcggactgtccaactcacctggcagccactcccagagcccctggaactctggcccaaggctctctgagtccttcccagatcttcttggctcagcggctgaagattgacactgcccgatcacctcggaagccccctagaccatcacggacgccgagctttgggtaactctcacagtggaaggtaagtccgtccccttagtcaatacggagggcacccactccacattaccttcttttcaagggcctgtttcccttgcctccataactgttgtgggtattgatggccaggcttctaaatccctgaaaactccccaactctggtgccaacttggacaacactcttttatgcactcttttttagttatccccacctgcccagttcccttattaggctgagatattttaaccaaattatctgcttccctgactattcctggactacagccgcatctcattgccacccttctccccaacccaaagcctccttcgcgtcttcctctcgtatccccccaccttaacccacaagtatgggacatctctactccttccctggcaaccgatcacatgcccattaccatcccattaaaacctaattacccttaccccgctcaatgccaatatcccatcccacagcacgctttaaaaggattaaagcctgttatcactcgcctgctacagcatgggcttctaaaacctataaactctccttacaattcccccattttacctgtctaaaaaccggacaagtcttacagattagttcaggatctgcgccttatcaaccaaattgttttgccatccatcctgtggtgcccaacccatacactcttttgtcctcaataccttcctccacaactcactattccgttctcgatcttaaagatgcttttttcactattcccctgcacccctcttcccagcctctctttgctttcacttagactgaccccgacacccattaggctcagcaaattacctgggctgtactgccgcaaagcttcacagacagcccccattacttcagtcaagctgaaatttcttccttatctgttacctatctcagcataattctcataaaaacacacgtgctttccctgctgatcgtgtccgattaatctcccaaacctcaatcccttacaaaacaacaactcctttccttcctaggcatggttagtgcagtcagaattcttacacaagagccaggaccacaccctgtagcctttctgtccaaacaacttgaccttactgttttagcatagccatcatgtctccgtgcagtggctgctgccgccctaatacttttagaggccctcaaaatcacaaactatgctcaacttactctctacatttcttataacttccaaaatctattttcttcctcatacctgatgcatatactttctgctccccggctccttcagctgtactcactctttgttaagtcccacaattaccatagttcctggcccggacttcaatccggcctcccacattattctggataccacacctgaccctcatgactgcatctctctgatccacctgacattcaccccatttctccatatttccttctttcctgttcctcaccctgatcacgcttgatttattaatggcagttccaccaggcctaatcgccacacaccagcaaaggcaggctatgctatagtacaagccactagcctgcctcttagaacctctcattttctttccatcgtggaaatctatcctcaaggaaataacttctcagtgttccatctgctattctgctactcctcagggattattcaggctccctcccttccctacacatcaagctcaaggatttgcccccacccaggactggcaaattagctttactcaacatgcgagtcagataactaaaatacctcttagtctaggtagacactttcactggataagtagagtcctttcctacaaggtctgagaaggccaccgcagtcacttctttccttctgtcagacataattcctcagtttagccttcccacctctatacagtctgataacagaccagcctttattagtcaaatcagccaagcagtttttgaggctcttagtattcagtgaaacctttatatcccttacagtcctcagtcttcaggaaaagtagaacggactaaaggtcttttaaaaacacacctcaccaagctcagccaccaacttaaaaaggactggacaatacttttaccactttctcttctcagaagtcagacctgtcctcagaatgctacagggtacagcccatttgagctcctgtatagatgctcctttttattaggccccagtctcattgcagacactagaccaacttagactgtgcccccaaaaaacttgtcatccctactatcttctgtctagtcatactcctattcaccgttctgaactactcatacatgccctgctcttgtttacactgccggtttacactgtttctccaagccatcacagctgatatctcctggtgctatccccaaactgccactcttaactcttaaagtaaataaataatctttgctggcaggactatgctgaatcttcttaggcgctctctaatcagatgtcctgaatcgtcccaattcttagacctcttatacctgtttttctccttctcttattccatttagtttttcaattcgtacaaaactgtatccaggtcatcaccaataattctaaattacaaatgttccttataacaaccccacgatatcaccccttaccacaaaatcttccttcagcttaatctctcccactctaggttcccacactgcccctaatcctgctggaagcagccctgagaaacatcacccattatctctccataccacccccaaaaattttcaccatcctaacactttaccactatttcattttatttttcttattaatataagaagacaggaatgtcaggccgctgagcccaagctaagccatcatatcccctgtgacctgcacgtacacatccatatccccggttcctgccttaactgatgacattccaccacaaaagaagtgaaaatggcctgttcctgccttaactgatgacattgtcttgtgaaattccttctcctggctcatcctggctcaaaagctcccccactcagtaccttgtgatcccccactcctgcctgccagagaacaacccccctttttcctttacctacccaaatcctataaaacggccccacccctatctccctttgctgactctcttttcggactcagcccacctgcacccaggtgaaataaacagccatgttggttgctcacacaaagcctgtttggtggtctcttcacacagatgcgcatgaaa

SEQ ID NO: 159 - DNA, 277 bp, Homo sapiens
gtaggagatcagtcagggtggcgggaaaaactgtggaaagatgcaaaccttcttggaaggctgggaggttttacaaaagcttcggaaaaggatttggctgaaggcagccagattctcttatccggtgcctaaaagcttaggttagatagaaaggggatgaggggtgaccatgttaattacccacaagtgtgttgactcaaggcctctgtcattaaatctgtactaaataaatgcctgcagccccagcttgtcagggctgcagctgctacaactcttt

SEQ ID NO: 160 - DNA, 3555 bp, Homo sapiens
gtcagtcctctgagcccaagctaagccatcattatctcctgtgacctgcatgtacatatccagatggccggttcctgccttaactgatgacattatcttgtgaaattccttctccttgctcatcctggctccaaagctcccctactgagcaccttgtggcccccactcctgcctgccagagaacaacccccctttttcctttacctacccaaatcctataaaattgccccacccctatctcccttcactgactctctttttggactcagcccacctgtacccaggtgaaataaacagctttactgctcacacaaagcctgtttggtggtctcttcacatggatgcatgtgaaatttggtgccgtgactgggatcgagggacttcccttgggagatcaatcccctgtcctcctgctctttgctctgtgagaaagatccacctatgacttcaggttctcagactgaccagcccaagaaacatctcaccaatttcaaatctggtaagcggcttctttttactctcttctccaacctccctcactatccctccacctctttctcctcccaatcttggcaccacacttcaatctctcccttctcttaatttcaattcctttcattttctggtagagacaaaggggacacgttttatctgtggacccaaaactctggcaccagtcacggactagtgaaggcagcctttccttggtgtttaatcacttgcagggacacctctctgattattcaccgaggtttcagaggtgtcagaccatgcagggatgcctgccttgttccttcacccttagcagcaagacctgcttttctgggggagggacaagaacccctcaaccccttctccttcacccttagcagcatgtcccacttttctgggggagggacaggaaccccgacctcttatctctgcaccccgatcccttatttccatgccctgacctcatctctgtgtcccgatcccttatttccacaacctgacctcttatctctgcaccccaaccctttatttctgtgcccccaaccctttccctctattctggaaggcaagaaccccccaccccttctctccatgtctctactctctcttttctctaggcttgcctccttcactatgggcaagcttccgccttccattcccctttcttctcccttaccctgtgttcttcaaaacctaaaacctcttcaactcacacctgacctaaaacctaaatgccttattttcttctacaatgctacttgaccccaatacaaactcagcagtggttccaaatagccagagaatggcactttcaatttttccatcctacaagatctagatacttcttgtcataagatgggcaaatgatctgagatgcctgatgtccaggcattcttttacacattggtccctccctagtctctgttcccagtgcaactcatccgaaatcttcctcctttccctcccacctgtcccctcagtcccaaccccaagtgtcgctgagtctttctaatcttccttttctacagacccatctgacctctcccatcctggccagcctgagctaggtcccaattcttcctcagcctccacttctccaccctataatccttttatcacctcccctcctcacactgggtctggcttacagtttaattccgtgactagccctcccccacctgcccagcaatttactcttaaacaggtgcctggagctaaagacatagtcaaggttaatgctcctttttctttatcccaaatcagatagcatttagcctctttttcatcaaatataaaaatccaccccagttcatggctcgtttggcagcaaccctgagatgctttacagccctagaccttaaaacgtcaaaaggccgtcttattctcaatatacattttattacccaatctgctcccgacattaaataaaactccaaaattaaattccggccctcaaaccccacaacaggacttaattaacctcaacttcaaggtgtacaataatggagtagaggcagcctagcagcaacatatttctcagttgcaattccttgcctccactgtgagacaaagcccagccaaatctccagcacacaagaacttccaaacgcctaaagcgcagtggccaggcattcctccagaaccacctaccccaggagcttgctacaagtgccagaaatctggccaccagaccaaggaatgcctgcagcccgggattcctcctgagccatgtcccatctgtgcgagacccaactagaaatcggactgttcaactcacctggcagccactcctagagcccctggaactccagcccaaggctctctgactcattccttcccagatcttcttggcttagcagctgaagactgacactgcctgatagatcacctcggaagcctacaggaccatcacagacgctctaggtaactctcacagtggaggagaagtccatccccttcttaatcaatacggaggctaaccactccacattaccttcttttcaagggcctgtttcccttgtctccataactgttgtgagtattgacagccaggcttctaaacctcttaaaactccccaactctggtgccaacttagacaatactcttttaagcactcctttttagttgtccccacctgcccagttcccttattaggctgagacactttaactaaattatctgcttccctgactattcctggactacagccactcctcattgccacccaccttaacccacaagtagaagatacctctattccctccttggcaacctatcacgcaccccttaccatctcattaaaacctaatcactcttacccctctcaatgccaatatcccatcccacagcatgctttgaaaggattaaagcctgttatcactcacctgctacagcatggccttttaaagcctataaactctccttacaattcccccattttacctgtcctaaaaccagacaagccttacaagttagttcaagatctgtgccttatcaaccaaattgttttgcctatccaccccaaggtgccaaacacatatactctcctatcctcagttcctccctccacaacccattattctgttctgaatctcaaacatgctttctttactattcctttgcacccttcatcccagtcactcttcgctttcacttggactgaccctgacacccatcaagctcagcaaattacctgggctgtactgtcgcaaagcttcacagacagcccccattacttcagtcaagcccaaatttctcccttatctgttacctatctcagcataattctcataaaaacacacgtgctctctctgccgatcgtgtgtgactcatctctcaaaccccaaccccttctacaaaacaacaactcctttccttcctgtgcatggttggatactttcacctttagatatctggttttgccatcctaacaaaaccattatataaactcacaaaaggaaacctagctgaccccatagatcctaaatcctttccccactcctctttctgttccttgaagacagctttaaagactgcccccaccctagtcttggttccctgac

SEQ ID NO: 161 - DNA, 381 bp, Homo sapiens
gtcaggcctctgagcccaagctaagccatcatattccctgtgacctgcaggtatacatccagatggcctgaagcaactgaagaatcacaaaagaagtggaagtggtcagttcctgccttaactgatgacattaccttgtgaaattccttctcctggctcagaagctcccccactgagcaccttgtgaccccggcccctgcccaccagcgaacaagcccctttgactgtaattttccattacctactcaaatcctataaaatggctccacctctatctcccttcactgactctcttttaggactcagcctgcctgcacccaggtgattaaaaagctttattgctcacacaaagcctgtttggtgatctcttcatacggacac

SEQ ID NO: 162 - DNA, 796 bp, Homo sapiens
gagagacaggactagccggatttcctaggccaactaagaatccctaaccctagctgggaaggtgaccgtgtccacctttaagcatggggcttgcaacttagctcacacccaaccaatcagatagtaaagagagctcactaaaatgctaattaggcaaaaacaggaggtaaagaaatagccaatgatctatcgcctgagagcacagcagaagagacaatgatcaggatataaacacaggcattcgagccggcaatggcaaccccttcaggtcccctccctttgtatgggagctctgttttcactctattaaatcttgcaactgcactcttctggtccctgtttgttacggctggagctgagctttcgctcgccgcccactgatgctggccgccgtcacagacccaccgctgacttccatccccctggatcccgcagggtgtccgctgtgctcctgatccagcaaggcgcccactgctgctcctgatcgggctaaaggcttgtcattgttcctgcacagctaagtgtccgggttcgtcctaatcgagctgaacactagtcactgggttccatggttctcttccgtgacccacggctcctaatagagctataacactcaccgcatggcccaagattccattctttggaatccgtgaggccgagaaccccacgtcagagaatacgaggcttgccaccatcttggaagcagcccgccaccatcttggaagcagcccgccaccatcttggaagcagcccaccaccatcttgggagctctgggagcaaagacccctggtaaca

SEQ ID NO: 163 - DNA, 5089 bp, Homo sapiens
gtcaggcctctgagcccaagctaagccatcatatcccctgtgactgcacgtacacatccagatggcgggttcctgccttaactaatgacattccaccacaaaagaagtgaaaatggcctgttcctgccttaactgatgacattaccttgcgaaattccttttcctggctcatcctggctcatcccagctcaaaagctcccccactgagcaccttgtgacccccaccccttcccgccagagaacacctcccctttgactgtaattttcctttacctacccaaatcttataaaatggccccacccctatctcccttcgctgactctcttttcggactcagcccatctgcacccaggtgaaataaatagccttgttgctcacacaaagcctgttagaatcgtcccaaattctccttctttccgtctcgcctgtcccctcagttccaaccccaagcgtcactgagtctttcttccttttctacagacccatctggcctttcccctcctccccaggctgctccttgccaggccgagctaggtcccaattcttcctcagcctctgctcctccaccctataatctttttatcaccgcccctcctcacacctggtccggcttacagtttcgttccacgactagccctcccccacctgcccagcaattggtggctggagctaaaggcatagtcaaggttaatgctccttttcctttttccttatcccacctctcccaaatcagttagtgtttaggctctttttcatcaaatatgaaaaacccagcccagttcatggctcatttggcagcaaccctgagatgctttatagccctagacctaaaaggtcaaaaggccgtcttattctcaatatacattttattacccaatccgctcccgactttaaagctccaaaaattaaattccggccatcaaaccccgcaacaggacttagttaacctcaccttcaaggtgtacaataatagaaaaaaagttgcaattccttgcctccactatgagacaaaccccagccacatctccagcacacaagaacttccaaacgcctgaaccgcagtcggccaggtgttcctccagaacctcctctcccaggagcttgctacaagtactggaaatctggccaccgagccaaggaatgcccacagccccggattcctcctaagccgcatcccatctgtgcgggaccccactgaaaatcggactgttcaactcacctggcagccactcccagagcccctggaactctggcccaaggctctctgactgactccttcccagatcttctccacttagaggctgaagactgacactgcccgatcgcctcggaagccccctagaccatcatggatgccaggcttcgggtaactctcacagtggagggtaagtccgtcaccttcttaatcaatacagaggctactaattccatattaccttcttttcaagggcctgtttcccttgcctccataactgttgtgggtattgacggccaggctttaaacctcttaaaactccccaactctgctgccaacttggacaacattattttatgcactcttttttagttatccccgcctgcccagctcccttattaggtcgagacattttaactaaattatctgcttccctgactattcctaggctacagccacacctcattgccacctttccccccagttcaaagcctcctttgcatcctcctgtcatatccccccaccttaacccaccagtatgggatacctctactccctccttggcgaccgatcatgcaccccttaccatctcattaaaacctaatcacccttaccccgttcaatgccaatatcccatcccacaacacgctttaaaaggattaaagcctgttatcactcacctgttacagcatggccttttaaagcctataaactctccttacaattcccccattttacctgtcctagaaccagacaagccttacaggttagttcaggatctgtgccttatcaaccaaattgttttgcctatccaccccgtcgtgccaaacccatatactctcctatcctcaatacctccctccacaacccattatttctgttctggatctcaaacatgctttctttactatccctttccacccttcatcccagcctctctttgctttcacttagactgaccctgacacccatcaggctcagcaaattacctgggctgtactgccacgaggcttcacagatagcccccattacttcagtcaagcccaaatttcatccttatctgttacctatctcggcataattctcataaaaacacatgtgctctccctgctgatcgtgtctgactaatctcccaaacctcaatcccttctacaaagcaataactcctttccttcttaggcatggttagtgtggtcagaattcttacacaggagccgggaccacaccctgtagcctttctgtccaaacaacttgaccttactgttttagcctagccctcatgtttgcgttcagcggctgccggtgctttaatacttttagaggccctaaaaatcacaaactatgctcaactcactctctacagttcttataacttccaaaatctattttcttcctcatacctgacgcatatagtttctgctccccggctccttcagctatactcactctttgttgggtctcccacaattaccattgttcctggcctggacttcaatccggcctcccacattattctggataccacacctgaccctcatgactgtatctctctgatccacctgatattcaccccatttccctatatttccttctttcctgttcctcaccctgatcacatttggtttattaatggcagttccaccaggcctaattgccactcaccagcaaaggcaggctatgctatagtatcttccacatgtatcattgaggctaccactctgcccccctccactacctctcaacaagctgaactagttgccttaactcaagccctcactcttgcaaaaggactacgcatcaatatttatactgactctaaatatgcctttcatattctgcaccaccatgctgttgtatgggctgaaagaggtttcctcactacgcaagggtcctccatcattaatgcctgtttaataaaaactctgctcaaggccgctttacttccaaaggaagctggagtcattcactgcaaaggccatcaaaaggcatcagatccctttgctctaggcaatgtttatgctaaggtggctagacaagcagctagctttccaacttctgtccctcatggccagtttttctccttcacgtcagtcactcccacctactcccccgctgaaacttccacctatcaatctcttcccacacaaggcaaatggttcttagaccagggaaaatatctccttccagcctcacaggcccattctattctgtcatcatttcataacctcttccatgtaggttataagccgctagcctgcctcttagaacctctcatttcctttccatcgtggaaatctgtcctcaaggaaatcacttctcagtgttccatctgctattctactacccctcagggattgttcaggcctcctccctttcctacacataaagctcggggatttgcccctgcccaggactggcaaattgactttactcacatgccccgagtcagaaaactaaaatacctcttagtctgggtagacaatttcactggatgggtagaggcctttcctacagggtctgagaaggccactgcggtcatttcttcccttctgtcagacataattccttggtttggccttcccacctctatacagtccgatagcagaccagcctttattagtcaaatcagccaagcagtttttcaggctcttggtattcagtgaaacctttatatcccctacggtcctcagtcttcaggaaaggtagaatggactaatggtcttttaaaagcacacctcaccaagctcagccaccaacttaaaaaggaatggacaatactcttaccactttcccttctcagaattcaggcccgtcctcggaatgctacagggtacagcccatttgagctcctgtatggatgctcctttttattaggccccagcctcattccagacaccagatcaacttggactgtgcccccaaaaaacttgtcatccctactatcttctgtctagtcatacacctattcaccattctcaactactcataaatgccctgctcttgtttacactgccggtttatactgattctccaagccatcacagctgatatctcctggtgccatccccaaactgccactcttaacacttaaagtaaataatctttgctggcaggactatgctgaatctccttaggcactctctaattagatgtcctgggtccttccaattcttagacctttaatacctgtttttctccttctcttattctgtttagtttttcaattcatacaaaaccatatccaggccatcaccaataattctaaatgacaaacgtttcttctaacaaccccacaatatcaccccttaccagaaaatcttccttcagcttaatctctcccactctaggttcccacaccgcccctaatcccgctcgaagcagccctgagatacattacccattatctctccataccaccccccaaaatttttgccgtcccaacactttaccactatttcgtttttttattattaatttaagaagacaggaatgtcagacctctgagcccaagctaagccatcatatcccctgtgacctgcacgtacacatccagatggccggttcctgccttaactgatgacattccaccacaaaagaagtgaaaatggcctgttcctgccttaactgatgacattaccttgcgaaattccttttcctggctcaaaagctcccccactgagcaccctgtgacccccacccctgcctgccagagaacacccccctttgactgtaattttcctttacctacccaaatcttataaaacggccttacccctagctcccttcgctgactctctttttggactcagcccgcctgcacccaggtgaaataaatagccttgttgctcacacaaagcctgtttggtggtctcttcacacggacgcaagtgaaa

SEQ ID NO: 164 - DNA, 44 bp, Homo sapiens
tgttaacagattggagggctgttaatgctgtgattcaacccatg

SEQ ID NO: 165 - DNA, 980 bp, Homo sapiens
gtggagaaaagaaagagagatcagattgttactgtgtctatgtagtaaaggaagatataagacactccattttgatctgtactaagaaaaattgtttctgctttgagatgctgttaacctgtaactttagccccaaccctgtgcttacagaaacatgtgctgtaatgaatcaaagtttaatggatttagggctgtgcaggatgtgccttgttaatagtatgtttgcaggcagtatgcttggtaaaagtcattgccatcctccattctcgattaaccagggacataatgcactgcagaaagccacagggacctctgcccaagaaagcctgggtattgtccaaggtttcccctcactaagacagcctgagacatggcctcatgggaagggaaagacctgaccgtccaccagcccgacacccataaagggtctgtgctgaggagaagtagtgaaagagggaggcctctttgcagttgaggtaagaggaaggcttctgtctcctgctcgtccttgggaatggaatgtctcagtgtaaagctgaccattcccattcgttctattctgagatagaagaaaactgccctgtggctggaggtgagatacgctggcagcaatactgctctgttactctttgctacactgagatgtttgggtaaagagaaacataaatctagcctacgtgcacatccaggcacagtacctttccttgaacttattcatgatacagattcctttgctcacgtttccctgctgaccttctccccacctgttgccccactacactcccctcgctaagatagttaaaataatgatcaataaatactgagggaactcagaggctggcaccggtgtgggtcctccgtatgctgagtgccggtcccctgggcccactgttctttctctatactttgtctctgtgtcttatttcttttctcagtctctcaccccacctgatgagaaatatccacaggtgtggaggggc

SEQ ID NO: 166 - DNA, 667 bp, Homo sapiens
ttagagttggtagctaggcagacatgagcagggaaggagagggctcccccagcaggaatatcaggccaccatcaggtgatggtcaggtggttgttaaactgtctctctaaaataataattggttgcaccagggaaaggcagtctcccagtagatagaaaacacctggagctggtaatcagcagctttccgataagatctcaggagttgggtgagtgggctcaagcatgtgcactaagaggcaaaatggagtttaactggtacatgaccctcctctaggaacactcaactggtaagggaaaaacacctcagatgagcatgtgcataacttcagtaaatacactgtgcaacccctcccaagtgggcctctctaagcccaccccaagggaagaatcaggggagaagaaacacaaaccccaagtcatgccagtgtataaaaccccacagcaaaggtcggacgaggcacctgaatctcaagttgccaccctggccctcttccaagtgtactttacttttttttggtcctgctctaaaattttttaataaattctcagtcctgcttaaaaactcaccttggtctctcactctgccttatgcccctctgacgaattctctccatcgaggaggcaagaattgagttgctgcagacctgtatggatttgccgctgc

SEQ ID NO: 167 - DNA, 809 bp, Homo sapiens
tttgcctgcaactaaccaatggaaattacttaaaatccttcaccaaacctttcacttaggcattgatagcacccatcagatggacaaattattatttgttggaccaggccttttcaaaactatcaagcagatagtcaggtcctgtgaagtgtgccaaagaaataatcccctgtatgcaggccatacatttcaatctctgtatctttaacctccttgttaagtttgtctcttccagaatcaaagctataaaactacaaatggttctccaaatggagccccagatgcagtccatgactaagatctactgcggacctctggaccggcctgctagcccagctcccacattaatgacatcaaaggcacccctcccgaggaaatctcaactgcatgacacctactacgccccaattcagcaggaagcagttagagtggtcgttggccaacctccccaacagcacttgggttttctgttgagatgggggactgagagacaggactagctggatttcctaggccaactaagaatccctaagcctagctgggaaggtgactacacccacctttaaccactaggcttgcaacttagctcacacccgaccaatcaggtagtaaagagagcttgctaaaatgctaattaggcaaaaacaggaggtaaagaaatagccagtcatctatcgcctgacagcacaaggggcgggacaatgatcaggatataaactcaggcattcaagccagcaatggctacccactttgggtcccctcccattttatgggagctctgttttcactctattaaatctttcaactac

SEQ ID NO: 168 - DNA, 118 bp, Homo sapiens
tgggacaacagttatcagctcaatggcaacagtatataaaagtattgaaacagctgcttaaagctagcggagccttggttttgcaggctcaattaagggacctaatgcaaactgttgt

SEQ ID NO: 169 - DNA, 2336 bp, Homo sapiens
gtcatggccctcaggcaagcggactttggaggctctggaaaagggaaagactgggcaaattgaatgcctaatagggcttgctttcagtgcagtctacaaggacactttaaaaaaaagattgtctgaatagaaataagccgcccactcatccatgcctcttatgtcaagggaatcactggaaggcccactgccccaggggatgaagttcctctgagtcagaagccactaaccagatgatccagcaacaggactgagggtgcccggggcaagcgccagcccatgccatcaccctcacagagccccaggtatgcttgaccattgagggccaggaggttaactgtctcctggacagtggcgctgccttctcagtcttactcttctgtgccagacaactgtcctcctgatctgtcactatctgaggggtcctaggacaggcagtcactagatacttctcccaggcactaagttgtgactggggaactttactcttttcacgtgcttttctaattatgcctgaaagccccactcctttgttagggagagacatcctagcaaaagcaggggccattatacacctgaatataggagaaggaacacacatttcttgtcccctacttgaggaaggaattaatcctgacaattaattcctgacaacagaaggacaatatggatgagcgaagaatgcccattcccttcaagttaaactaaaagattcaccttctttccctaccaaaggcagtacccccttagacctgaggcccaacaagtacttcaaaagattaaggacctaaaagcccaaggcctagtaaaatcatgcaatagtgcaatagtccctacaatacttcaattttaggagtacagaaacccaatggagagtggagattagtgcaagatctcaggattatcaatgaggctgctgtccctgtataaccagctgcacctaacccttatgctctgctttcccaaataccagaagaagcagaatggtttacagtcctggaccttaaggatgactttttctgcatcccttacatcctgactctcaattcttctttgcctttgaagatccttcgaacccaacgtctcaactcacctggactgttttaccccaaggtttcaggccatctatttggccaagcattagcccaagacttgagccagttctcatacttggacactctcgtcctttggtatgtgaatgatttacttttagcctcctgttcagaaactttgtgccatcaagccacccaagcgctcttaaacttcctcaccacttgtggctacaaggtttccaaaccaaaggctcagctctgctcacagcagtttaaatacttagggctaaaattatccaaaggaaccagggccctcagtgaggaatgtaaccagcctatactggcttatcctcatcccacaacgctggatactgccaaaggaacctgaaaatgcaggagacaatgctagctattcctgcgaacctctacaggatctgtgcctgctcttcaaatgacaaccgtgaggaaagtaactagaatcgtagatccccgtggccctcccttgtcacatttttctctttactgttctcttacccactttcactctcattgcacctcctccatgctgctgtactaccagtagttcccctcaccaagagcttctatggataatgcagcttcccagaaatactgacacctcattgtataggagtttttctaaaggaaaccccactttcaccccccgtacacatactcgcccagtaagcctatttaataccactctcactgggctccatgaagcctcagcccaaaaccctactaactgttggatgtgcctcaccctgcatttaggccatacatttcaatccctgtatctttaatctccttgttaagtttgtctcttccagaatcgaaggtgtaaaactacaaatcgttcttcaaatggagccccagatgcagtccatgactaagatctactgcggacccctggactggcctgctagccaatgctctgatgttgatgacatcgagggcacctctcccaaggaaatctcaactgcatgacccctgctatgccccaattcagcagaaagcagttagagcagtcgtcagccaacctccccaacagcacttgggttttcctgttgagagaggggactgagagacaggactagctggatttcctaggccgactaagaattcctgaacctagctggggaagctgaccacacccacctttaaacacagggcttgtaactcagctcacacctgaccaatcaggttgtaaagagagcccagtaaaataccaattaggctaaaagcaggaggtaaagaaataatcaa

SEQ ID NO: 170 - DNA, 312 bp, Homo sapiens
tgggtcaggcacaaagtaagcccaccccactaggaactatgttgaaaaatttcaagaaaggatttaagggagattacagtggtactatgacaccaggaaaacttagaactttgtgtgacatagactggccagcattagaggtgggttggccatcagaaggaagcctggacaggtcccttgttacaaaggtatggcacaaggtaacctgtaagccagggcccccagaccagttcccgtacatagacacttggttacaactggttttagaccctcccgccccacacagtggttgagagaacagcagcataagtg

SEQ ID NO: 171 - DNA, 1154 bp, Homo sapiens
agttttgcctgacaaaggtctcttcttcctccgtggctcctccacctacatgtgtctgcgtatgaattggacaggcacatgaacactagttttccttactcccaaaaatctgtttgcaaataggaccaaacagctttctgttcccctcatgacaccaatacttcatcactattttgtcttatttttcttattaatataagatgacaggaataggcctcaacttactcgctgctgaaaaaggaggactgtatatatttttaaatgaagagtgttgtttttacctaagtcaatcttgcctggtatatgacaacataaaaaactcaacgatagagcccaaaaacttgccaaccaggcaaataattatgctaaacctccctgggcactttctaattggatttcccggctcctcccaattcttagtcctctactacctgtttttctccttctcttatttggaccttgtgccttccatttagtttctcaattcatacaaaaccgcatccaggccatcaccaatcattctatatgacaaatactccttctaacagccccaccatatcaccccttaccacaaaaccttccttctgtttaatctctcccactgtaggttcccacgccgcccctaatcccgctcgaagcagccctgagaaacattgcccattatctctctataccacctccaaaaattttcaacgccccaacactccaccactattttttgtttttcttattaatataaaaagacaggaatgtcaggtctctgagcccaagctaagccatcataacccctgtgacctgcatgtatacatccagatggcctggagcaactgaagaaccacaaaagatggcattccaccattgtgatttgttcctgccccactctaactaatcatttgaccttgtgacattccccacctggacaatgagtctcatgatcttcccaccctgcaccttgtgacccctgcccctgcccaaaagagataaccacctttaactgtacttttccactacctacccaaatcctataaaactgccccacccctatctccctttgctgactcctttttgggactcagtacgcctgcacccaggtgattaaaaagctttattgcgcacacaaagcctgtttggtggtctcttcataaggatgcatg

SEQ ID NO: 172 - DNA, 972 bp, Homo sapiens; identical to SEQ ID NO: 127

SEQ ID NO: 173 - DNA, 682 bp, Homo sapiens
ttagagttggtatttaggcagacatgagcagggcagaagagggccccctgccccagggatgtcaggtgaccatcaggtgatagccaggttgttgttaagctgtctctaattggccatgcctggcactagggaaaggctgtcttccagtagacaggaaacatctgaagctggtgatcagcttcctgataggatctcaggagctggatgagtgggcccaagtatgtgcactaaatggcaaaatggcagagtttaactggtatgtgaccttcctctaggaatgcttacctggaaagggtaatgatcttgcacacaatttcagcaaacacactgtgcatgctcctctcccaagtgctggcaggccactgcatgggagcagcctgctgcaagggaagaatcagggaagaagaaatgtggaccctggagtcatgtcatacaagaccccacccaagtcgagggtcagacagagcacttgaatctctcaagtcgcctgcttggccctttccaactgtactttactccctttcattccttctctaaaactttttagtaaacttttactcctgctctaaaacttgcctcagtctctcaccctgcctgctgccccttggctgtattctttcttctgcaaggcaagaattgagttgctgcagacttgtacagatccacccctgctaacaagact

SEQ ID NO: 174 - DNA, 680 bp, Homo sapiens
ttagagtaggtagttaggcagacatgagccaggcaggagagcctctcccaaccccagagaacttcaggggaccatcaggtaatggtcaggtggttgttaaactgtgtctctgaaattataattggtcacagctggtactagggaccgacagtctcccaataaataggaaactcctggagctgtggaggagcagcagcttcccgataagatctcagggattgggctagtgggctcaagcatgcactaagaggcaaaatggcaaagtttaactggtatataaccttcctctgggaatttttgtctaatgaggggaaaaacacctcaagtgagcatgcacacaacttcagtaaacacactgtgtatgcaccccttcccaagtgctggcgggccactgtgcctgtggacagcctgccgcaagggagaaatcaagggaggagaaactcaaatcccggaaccaagccaatgtattaaaatcccaagccaaaggttggacggggcacttggatctctcaaggaacccacttgaccctcttccaagtgtgctttgcttcctttcactcaggctctaaaactttttaataaactctcacttttgctctaaaacttgcctcagtctctccctctgccttaaacatacttctgcccctcagccaaattctgtcctccagagaggcaaggat

SEQ ID NO: 175 - DNA, 972 bp, Homo sapiens
gtggggaaaagaaagagaaatccgactgttactgtgtctatgtagaaagaagtagacataagagactccattttattctgtactaagaaaaattcttctgccttgagatgctgttaatctgtaaccctacccccaaccctgtgctccctgaaacatgtgctgtgtcaactcagggttaaatggattaagggctgtgcaggatatgctttgttaaacaaatgcttgaaagcagcatgcttgttaagagtcatcaccactccctaatctcaagtacccagaaacacagtacactgaggaagtccgcagggacctctgtctaggaaagccaggtattgtccaaggtttctccccatgtgacagtctgaatatggcctcctgggaagggaaagacctgaccatcccccagcctgacaaccgtaaagggtctgtgctgaggaggattagtaaaagaggaaggaaggcctctttgcagttgagataagaggaaggcatctgtctcctgctcatccctgagcaatggaatgccttagtgtaaaaccccattgtatattccatctactgagatggggaaaactgccttagggctggaggtgggacatgctggcagcaatactgctctttaaggcattgagatgtttatgtatatgcacatcaaaagcacagcacttttttctttaccttgtttatgatgcagagacatttgttcacatgttttcctgatgaccttctccccactattaccctattgtcctgccacatccgcctctccaagaaatgcccgataatgatcaataaatactaaaggaactcagagactggtgccggcgcgggtcctccatatgctgagcgccagttccctgggcccacttttctttctctatactttgtctctgtgtctctttcttttcttaagtctctcatcccatccgatgagaaacgcccacaagtgtggaggggcaggccaccccttca

SEQ ID NO: 176 - DNA, 5754 bp, Homo sapiens
acttggaggactgtgggtattaggtgtccaagaagaaagctcaaatctgctgacggcaggtaccttacttgggatttactctccgacaggggtccgaactcagcccgggaacagaaagaaagcaggttatttgcaatctaccggagcctaagggcagaaggcaggtgagggaattcttgggagctgtggggttttgtagactgtgcatcccaaactttgcagtattagccaagcccttttatgaggtcacaaagggggcggggaccgggaacctttggaagggggatcccaacaacagcaagtctttcatgagttaaaggaaaaacttccggcagccgcagccctgggataaccgatctgacaaagccttttccattgaatgcatcagagagaaaatagatggcagctggacatttaacccaaagtgtggagccctggctgaggccggtggcctacgtctctaaacaactagacaggttttctaaaggatggcccccctgtttgagggcagtggcagcaactaccctgctagtagaagacgcaaataagctgactcttgggcaaaacctgaacataaaggccccccattttgcggtgggtgagagccagcccttcttacccccttgcctctcaggacccccatcgcagggcgggaggcacctcccatgaggcggggactgagaggcagcccctcttccccccttggctcttgggaaccccatcgcagggtggggaggcaacccccgtgatgaagggaaaaaaagagccagcccctcttccccccctggctcttaggaccaccatcgcaggaaggggaggcaacccccacgggggagggactgacagccatcccctcttctcccctggctcttaggacccccattgcagggggggggaggcaccctccgagaggcggggactgagagccagcccctcttccagctctggcttaggacccccatcgcggatcctatgtaccttaggaccctcctggaggactgtgggtataggtgtccaagaagaaagctcaaatctgccgaaggcaggtaccttacttgggatttactgtccaacaggtgtcagaacgcagcccgggaacagaaagtaagcaggtcatttgcaatctaccagagcctaggggcggaaggaaggtgaggaaattcttaggggctgtggggttttgtagactgtgcatcccaaactttgcagtattagccaagcctttgtatgaggtcacaaaaggggcgaggaccaggaacctatggaatcgggatcccaacaacagcaagtctttcatgagttaaaggaaaaacttctggcagccccagccctgggtctacccgatctgacaatgtcttttccattgaatgcgtcagatagagaaaagatggcagctggacttttaatccaaactctggggccctggctgaggccggtggcctacgtctctaaacaactaaaaagggtttctaaaggatggcccccctgtttgagggccgtggcagcaactgccctgatagtagaagaagcaaataagctgactcttgggcaaaacctgaacataaaggctgcccattttggggtgggtgagagccagcccctcatccctccctgccttaggacccccatcgcgcatcctaagatccttaggacccacctggaggactgtgggtattaggtgtccaagaagaaagctcaaatctgccgacggcgggtaccttaattgggattgactatccgacaggggtcccacgccgcccgggaacagaaagaaagcaggttatttgcaatctaccagagcctaagggtcgaaagcaggcgagagaattctcaggagctgtggggttttgtagactgtggatcccaaactttgcagtataagccaagcctttgtatgaggtcacaaagggggcggggaccgggaacctttggaatggggatcccaacaacagcaagtctttcatgagttaaaggaaaaacttctggcagcttcagccctggggctacccaatctgacaaagccttttagattgtacacgtcagagagagacaagatggcgggtggacttttaacccaaactgtggggccctggaagaggccggtggcctacgtctctaaacaactagacagggtttctaaaggatggcaccctgtttgggggccttggcagcaactgccctgctagtacaagaagaaaataagctgactcttgggcaaaacctgaacataaaggccccccgttttgtggtggctgagagccagcccctcttcccccactggctcttgggacccccatcgcgttgggggggaggcaccctccgcgaggcggggactgagagccagcccctcttccccccctggctcttgggacccccatcccagggggggaggcacccccacgaggcggggactgagagccagcccctcatccccccttggttcttgggaaccccatcgcagggggggatgcaacccccgcgacgagaggacagagagccagcccctcttcacccctggctcttaggacccacatcgcacctgagggaggcacccccgcgaggcggggactgacagccccctcttcccccccagactcttgggatcaccatcgcaggggcgggaggcacaccccgcgaggcggggactgacagccagcccctcttccccccctggctcttaggacacccaccgcagagggggggaggcaccccccgccaggcaggaactgagagccagcacctcttcccccgctggctcttaggacccccatcgcagagcgggaggcaccgcccatgaggcagggactgagaaccagcccctcttcccccctggctcttaggacccccatcgcagtagggggaggcagcccccgcgagccgaggattgagagccagcccgtattccccccctgacacttgggacccccatcgcagggtgggaaggcaccccccgcgaggcgggtactgacagccaggccctcttcccccccgaatcttgggacccccatcgcagtgggggaggcacccccgcgaagcggggactgagagccagcccctttccccccttggctcttgggacggccatctcaagaggggggatgcaaaccctgcaacgaggggacagagagacagcccttcttcaccccctggctcttaggacccccatcgcacctggggagggcacccccgcgaggcggggactgagagccagcccgtcttccacccctggctcttcggaaacccatggcagcggggcgaggcagcccccacgaggcggggactgagttccagcccctcttcaccacctggctcttaggaccaccatctcagaggcgggaggcaccacccgcgaggtggggactgagagccagccactcttcccccgctggcttaggacacccatcgtggatcctaagaaccttaggacccacctggaggactgtgggtattaggtgtccaggcagaaagctcaaatctgccgacggcaggtaccttacttgggatttactatcggacggggtccgacgcctccctggaacagaaagaaagcaggttatttgcaatctaccagagcctaagggccgaaggcaggcgagagaattctcaggagctgtggggttttgtagactgtggatcccaaactttgcagtataagccaagagtttgtatgatgtcacaaagggggcgaggactgagaacctttggaagggggatcccaacaacagcaagtctttcatgagttaaaggaaaaacttctggcagcttcagccctggggctacccgatctgacaaaaccttttccattgtatgcgtcagagagacaagatggcaggtggacttttaacccaaactattgggccctggatgaggccggtggcctacttctctaaacaactagacagggtttctaaaggatggccccctgattgagggccttggcagcaactgccctgctagtacaagaagcaaataagctgactcttgggcaaaacctgaacataaagtccccccattttgtagtggctgagagccagcccctcttccccccctggctcttgggaccccatcacgtggggggggaggcaccctccgcgaggcggggactgagagccagcccctcttcccccctggctcttaggactcccatcacagtggggggaggcagcccccgcgagccgaggactgagagccagcacctatacccccctgacacttgggacccccatcgcagggtgaggaggcaccccccgcgaggcggggactgagagctagcccctcttcacccctggctcttaggacccacatcgcacctgtgggaggcacccccacgaggcggggactgagagacagcccctcttcccccccagactcttaggatccccatcccggagagggaggcacaccccgcgaggcagggactgagagccagcacctggtcccccccctggcttaggacccccatcgtggatcctatgaactttaggacacacctggaggactgtgggtataggtgttcaagaagaaagctcaaatctgccgatggcaggtaccttacttgggatttactatccgacaggggtccgaacgcacccgggaacagaaagaaagcaggacatttgcaatctaccgcagcctaagggcagaaagcatgtgagggaattcttaggggctgtgggattttgtagactgtgcatcccaaactttgcagtattagccaagactttgtatgagatcgcaaagtgggcggggaccgggaacctatggaatcgggatcccaacaacagcaagtctttcttgagttaaaggaaaaacttctggcagccccagccctggggctacctgatctgacaaagccttttccattgaatgcatcagatagagaaaacatggcagccggacttttaactcaaactgtggggccctggatgaggccagtggcctacgtctctaaacacctagacagggtatctaaaggatggcccccctgtttgagggccatggcagcaactgccctgatagtagaagaagcaaataagctgactcttgggcaaaacctgaacataaaggccacccattttggggtgggtgagagccagcccctcttccccccctgccttaggacccccattgcagatactaagatctttaggacacacctggaggactgtgggtattaggtgtccaagaagaaagctcaaatctgcctagggcaggtaacttacttgggatttccgatccgacaggggtccgaagccacccgggaacagaaagaaagcatgttatttgcaatctaccagagcctaagggccaaaggcaggcgagagaattctcaggagctgtggggttttgtagactgtggatcccaaactttgcaatataagccaagcctttgtatgaggtcacaaagggggcggggaccgggaacctttggaatggggatcctaacaacagcaagtctttcatgagttaaaggaaaaacttctggcagcttcagccctggggttacccgatctgacaaaaccttttccattgtatgcgtcagagagagaaaagatggcaggtggacttttaacccaaactgtggggccttggatgaggccggtggcctatgtctctgaacaactagacagggtttctaaaggatggcccccctgtttgagggccttggcagcaactcccctgctagtacaagaagcaaatgagctgactcttgggcaaaacctgaacataaaggccccccattttgtggtggct

SEQ ID NO: 177 - DNA, 316 bp, Homo sapiens
gagagacaggactagctggatttccaaggccgactaagaatccctaagtctagctgggaaggtgactgcatccacctttaaacatggggctttcaacttagctcacacccgaccaatcaggtagtaaagagagctcactaaaatgctactaattaggcaaaagcaggaggtaaagaaatagccaatcatcaaatgcctgagagcacagggggagggacaatgattgggatataaacccaggcattcaagcaggcaatggcagccccgtgtgggtcccctcccattgtatgggagctctgttttcactgtattacac

SEQ ID NO: 178 - DNA, 5971 bp, Homo sapiens
gtcaggcctctgagcccaagccaagccatcgcatcccctgtcacttgcacgtacacacccagatggcctgaagtaactgaagaatcacaaaagaagtgaatatgccctgcctcacctcaactgatgacattccaccacaaaagaagtgaaaatggcctgttcctgccttaactgatgacattgtcttgtgaaattccttttcctggctcatcctggctcaaaaacctcccccactgagcaccttgcaacccctacgcctgctcgccagagaacaaaacccctttgactgtaattttcctttacctacccaaatattataaaacggccccacccctatctccctttgctgactctcttttcggactcagcccgcaggcacccaggtgattaaaagctgtattgctcacacaaagcctgtttggtggtctcttcacacggacgcgcatgaaatttggtgccgtgactcagatcgggggacctcccttgggagatcaatcccctgtcctcctgttctttgctccgtgaaaaagatccacctacgacctcaggtcctcagacccaccagcccaaggaacatctcaccaattttaaatcgagtaagcggcctcttcttactctcttcttcaacctctctcactatccctcaaccactttctcctttccactcttcaatctctcccttctttcaatttcaattcctttcattttctggtagagacaaaggagacatgttttatccgtggacccaaaaccccggcgccggtcacagactgggaaggcagccttcccttggtgtttaataattgcagatacgcctctctgattattcacccacgtttcagaggtgtcagatcacgcagggacgcctgccttggtccttcacccttagcggcaagtcccacttttctggggggggcaagtaccccaaccccttctctctgtgtctctaccccgtctccacctttctggggggcaagaaacccctaacccttctccttcactcttagcagcaagtcccgcttttctagaggaggggcaagtaccccaaccccttctctccatgtctctacctcttctccgcctttctggggggcaagaaactcccaaccccttctccttcatccttagcggcaagtcctgcttttctgggggaggggcaagtaccccaaccttgtatctctgcgccccgatcccttatgtccatgccccgacctcttatatctctgtgctccgatcccttatttccacgccccaacctgttatatctctgcgccctgatcccttatttccatgccccgaccttgtatctctgcgccccgacccctttcccacttttctggagggtaagaacccctgaaccccttccctcctgtctctatcttttctctgggcttgcttccttcactatgggcaaccttccaccctccattcctccttcttctcccttagcctgtgttctcaaaaacttaaaacctcttcaactcacatctgacctaaaacctaaatgccttactttcttctgcaatgccacttgaccccaatacaaactcaacagtggtaccaaatagccagaaaatggcactttcaatttttccatcctacaagatataaataattcttgtcgtaaaataggcaaacggtctgaggtgcctgacgtccaggcattcttttacacatcagtcccttcctagtctctgttcccaatgcaactcgtcccaaatcttccttctttccctcccgcctgtcccctcagtcccaaccccaagcatcactgagtctccaatcttccttttctacagatctatctgacctctcccctcctcgccaggccgagctaagtcccaattcttcctcagccccctcttctccaccctataatccttttatcacctcccctcctgacacccggtctggcttacagtttcattccgtaactagccctctgccacctgcctagcaatttactcttaaaaaggtggctggagctaaagacatagtcaaggttaatgctcctttttctttatcccaaatcagatagcgtttaggctctttttcatcaaatataaaaatccagcccagttcatgactcgtttggcagcaaccctgagactctttacagccctagaccctaaaacatcaaaaggctgtcttattctcaaaatacattttattacccaatctgctcccaacattaaataaaactccaaaaattaaattctggccctcaaaccccacaacgggattaattaacctcgccttcaaggtgtacaataatagaaaaaagttgcaattccttgcctccactgtgagacaaaccccagccacaactccagcacacaagaacttccaaatgcctgaaccgcagcggccaggcgttcctccagaacctcctctgccaggagcttgctacaagtgccagaaatctggccaccaggccaaggaatgcctgcagcccaggattcctcctaagtcacgtcccatctgtgcaggaccccactggaaatcggactgtccaactcacctggcagccactcccagagcccctggaactctggcccaaggctctctgactgcttcccagatcttcttggcttagcggctgaagactgacactgcctgatcacctcggaagccccctagaccatcacggactccgagcttcgggtaaccttcacagtggaaggtaagtccgtccccttcttaatgaatacggaggctacccactccacattacctccttttcaagggcctgtttcccttgcctccataactgttgtgggtattgacggccaggtttctaaacctcttaaaactccccaactctggtgccaccttagacaatactcttttaagcactcctttttagttatccccacctgcccagttcccttattaggccaagacactttaactaaattatctgcttccctgactattcctgggctacagccacatctcattgccaccttttcccccacttcaaagcctccttcacatcctcctcttgtatccccccaccttaacccacaagtataggatacttctactcccttcttggtgaccgatcatgcaacccttaccatctcattaaaatctaatcacccttaccccactcaacgccagtatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgtgccttatcaaccaaattgttttgcctatccaccccatggtgctgaacccatatactctcctatcctcaatacctccctctacaacccattattctgttctagatctcaaacacgctttctttactattcctttgcacccttcatcccagcctctcttcgctttcacttggactgaccctgacacccatcacgctcagcaaattacctgggctgtactgccgcaaggcttaacagacatcccccattacttcagtcaagcccaaatttcttcctcatctgttacctgtctcggcgtaattcttagaaaaacacatgtgctctctctgccgatcgtgtctgactgatctctcaaaccccaacaccttctacatcctaggcatggttagatactttcgactttagatacctggttttgccatcctaacaaaaccattatataaactcacaaaaagaaacctagctgaccccatagatcctaaatcctttccccactcctttttccgttccttgaagacagctttagagactgccccaacccgagcgctccctgactcatcccaacccttttcattacacagagctgaagtgcagggctgtgcagtcggaattcttacacaaggaccgggatcgcgtcctgtagcctttttgtccaaacaacttgaccttactgttttaggctggccatcatgtctccgtgcagtggctgctgccaccccaatactttcagaggcccttaaaatcacaaactatgctcaactcactctctacagctctcataatttccaaaatctattttcttcctcacacctgatgcctatactttctgctccccagctccttcatctctctgatccacctgacgttcaccccatttccccacatttccttctcccctgtttctcaccctgatcacacttagtttattgatggcagttccaccaggcgtaatcgccacacaccagcaaaggcaggctatgctatagtacaagccactagcccgcctcttagaacctctcatttcctttccattgtggaaatctatcctcgaggaaataacttctcagtattccatctgctatgctactactcctcagggattattcaggccccctctcttccctacacatcaagttcagggatttgcccccgcccaggactggcaaattagctttactcaacatgccccgagtcaggaaactaaaatacctcttattctaagtagacactttcactgaataagtaaaggcctttcctacagggtctgagaaggccaccgtagtcatttcctcccttctgtcagacataattccttagtttagccttcccacctctatacagtctgataacagaccagcctttattagtcaaatcagccaagtagtttttcaggctcttagtattcagtgaaacctttacatcccttacagtcctctgtcttcaggaaaagtagaacagactaaaggtcttttaaaaacacacctcaccaagctcagccaccaacttaaaaaggactggacaatacttttaccactttcccttctcagaagtcagacctgtcctcagaatgctacagggtacagcccatttgagctcctgtatagacgctcctttttattaggccccagtctcattccagacaccagaccaacttagactgtgccccaaaaaaacttgtcatccctactatcttctgtctagtcatactcctattcaccattctcagctactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccatatccaggccatcaccaatcattctatacaacaaatgtttcttctaacaaccccacaatatcaccccttaccacaaaatcttccttcagcttaatctctcccactctaggttcccaagccaccccaatcctgctcgaagcagccctgagaaacatcgcccattctctctctccataccaccccccaaaaattttcgccaccccaacacttcaacactattttgttttatttttcttattaatataagaaggcaggaatgtcaggcctctgagcccaagccaagccatcgcatcccctgtgacttgcacatattcgcccagatggcctgaagtaactgaagaatcacaaaagaagtgaatatgccctgccccgccttaactgatgacattccaccacaaaagaagtgaaaatggcctgttcctgccttaactgatgacattgtcttgtgaaattccttttcctggctcatcctggctcaaaaacctcccccactgagcaccttgcaacccccactcctgcccgccagagaacaaaccccctttgactgtcattttcctttacctacccaaatcttataaaacggccccacccctatctccctttgctgactctcttttcagacttagcccgcctgcacccaggtgattaaaagctgtattgctcacacaaagcctgtttggtggtctcttcacacggacgcgcatgaaa

SEQ ID NO: 179 - DNA, 6101 bp, Homo sapiens
gtcaggcctctgagcccaagctaagccatcatatcccctgtgacctgcatgtatacatccagatggcctgaagcaactgaagatccacaaaagaactgaaaacagccttaactgatgacattccaccattgtgatttgttcctgccccaccctaagtgataggctatgttctcccccgcccttaagaaggtactttgtaatattctcccccgcccttaagaatgtactttgtacacctatcccaaacgtataaaaactaatgataatcccaccaacctttgctgactcctttctcggactcagcccacctgcacccaggtgaaataaacagccctgttgctcacacaaagcctgttggtggtctcttcacaaggatgcgtgtgacatttggtgccaaaacccaggacaggaggactccttcaggagaccagtcccctgtcttcgccctcactccgtgacctcaggtcctcagaccaaccagcccaaggaacatctcaccaacttcaaattgggtaagcagtcttttcactcttctcatgcctctcttgctacccttcaatcttcctctcttgctacccttcaatctccctgtccttccaattccaattctttttcctctctagtagagacaaggagacggccaggtgcggtggctcacgcctgcaatcccagctctcagggaggctaagaggcgggaggatagcttgagcccaggagttcgagacctgcctgggcaatatagcgagaccccgttctccagaaaaaggaaaaaaaaaaaaaaagagacaaggagacacattttatccgtggacccaaaactctggcgccagtcacggactcgggaagatagtcttcccttggtgtttaatcactgcggagatgcctgcctgattattcacccaccctccactggtgtctgatcactgcggggacacctgccttagtcattcacccacattcccttggtggcaagtcaattgcagggatgcctgctttggctgctcacccacattgcagcccagggctgctcacccacccacttctccatgtctctacctttctctttaaacttacctccttcactatgggcaaccttccactcgccattctcccttcttctcctttagcctgtgttctcaaaaacttaaaacctcttcaactcacacctgacctaaaacctaagcgtcttattttcttctacaacaccgcttggccccaatacaaacttgacaatgattccaaatagccagaaaatgacactttcgatttctccatcctacaagatctagataattcttgtcataaaatgggcaaatggtctgaggtgcctgacgtccaggcattcttttacacatcggtcccttcctaatctctgttcccaatgagattcatcccaaagctttcttctttctctcctgtctgttccttcagtctccaccccaagctctgaatcctgggaatcctccttttctacagacccatctgacctctaccctcctccccaggctgctccttgccaggccgagccagctcccaactcttcttcaacctctgctcccccaccctataacccttctattacctcccctcctcacacccggtctggcttacagtttcattccgtgaccagccctcccccacctgcccaacaatttcctctcagagaggtggctggagctgaaggcatagccaaggttaatcctcctttttctttatccaacctctcccaaatcagttagcgtttaggctctttttcatcaaatatgaaaacccagcccagtccatggcccgtttggcaacaacccttagatgctttaccgccctagacccagaggggccagaaggctgtcttattctcaatacacattttattacccaacccactcctgacattagaaaaatctccaaaaattagattctggccttcaaccccccaacagtacttaattgacctcaccttcaaggggtacagtaatacagaagagttgtaattacttgcctccgctgtgagagaaaccccagctacatctccagcacacaagaacttcaaaacgcctaaacctcaggggtcaggcattcctccaggaccgcctccccaggatcttgcttctagtgctggaaatctggccactgggccaaggaatgcctgcagcctgggattcctcctaagccgtgtcccatctgtgcaggaccccactggaaatcagactgtccaactcacccagcagccactcccagagcccctggaactctggcccaaggctctctgactgactccttcccagatcgtctcagcttagcggctgaagactgacactgcccgatcgcctcggaagcctacaggaccatcacagatgctctggataactcttacagtggagggtaagtccatcctcttctttatcaatacggaagctacacactccacattaccttctttccaagggcgtgtttcccttgcctccataactgttgtgggtattgacagccaggcgtctaaacctcctaaaactccccaactctggtgccaacttggaaaacattcttttatgcactcctttttagttatcctcacctgcccagctcccttattaggttgagacattttaactaaattttctgcttccctgactattcctgggctacagccacacctcattgcctccttttcccccagttcaaagcctccttcacatcctctccttgtatctccccaccttaatccacaagtataggacacctctactccctccttggcaacggatgatgcaccccttaccatcccattaaaacctaatcacccttaccctgctcaatgccaatatcccatcccacagcacgctttaaaaggattaaagcctgttatcactcacctgctacagcatggccttttaaagcctataaactctccttacaattccccattttacctgtccaaaaactacacgagtcttacaggttagttcaggatctgcaccctatcgaccaaattgtcttgcctatccaccctgtggtgccaaagccatatattctcccatcctcaatacctccctccacaacccattattctgttctagataaacctagctgaccccataaatcctaaatcctttccccactcccctttccattccttaaaaaacagccctaaaagatgctcccacactacctctccctaactcatcccaacctttttcattacacacagctgaagtgcagggctgtgtggtcggaattcttacacaagagccgggaccgcgccctggagcctttctgtccaaacaacttgaccttactcttttagcctagcccttacgtctgcgtgtggtggctgccgctgctttaatacttttagaggccctcaaaatcacaagctatgctccacttactctctacagttcccataactttcaaaatctattttcctcctcacacttgacgcatatactttctgccccccagctctttcagctatactcactctttgttgagtctcccacagttactattgttcctggcccagacttcaatccggcctcccacattattccggataccacacctgatccccatgactgtatctctctgatccacctgacattcactccatttccccatatttccttctttcctgttcctcaccctgataacacttggtttattgatggcagttccaccaggcctaatcgccactcaccagcaaagggaggctatgctatagtatctttcacatctatcattgaggctaccactctgaccccctccactacctctcagcaagctaaactcattgccttaacttgggccctcattcttgcaaaaggactacgagtcaatatttatactgactctaaatatgccttccatatcctgcaccaccatgctgttatatgggcagaaagaggtttcctcactactcaagggtcctccatcattaatgcctctttaataaatactcttctcaaggctgttttacttccaaaggaagctggagtcattcactgcaagggccatcaaaaggcatcagatcccactgctcagggcaacgcttatgctgataaggtagttaaagaagcagctagctttccaacttctgtccctcacggccaggactggacagtactttgcccttctcagaattagagcctgtcctcgagatgctacagggtactgtccatttgaacttttatatggacgcactttcttgctcagccctgacctcgtcccagacaccagccctctaggcaactatcttccagtcctccagcaggctagacaggaaattcgctaggctgctcatcttctcttgcctactccagattcccagccatatgaagacaccctagctggatgatcagttcttgttaagaatctgacccctcaaactctacaacctccatggactggaccccacttagtcatctatagtaccccaatggctgttcgtctgcaggatgccccaccattaggttcatcattccagaataaagctgtgcccgtcaaacagccagcctgatctctcctcttcctcctggaagtcacaagtgttcacccctactttccttaaacttatttgcatttctgaagagcagtaataacccttatgagcctaatacaacccttcattctattaggtctattcatccttaccctactttttgcaatagggctttacgcagtcacccccactacttgttctgtgccccaaaaacttgtcatccctatcttctgtctagtcatactcctattcaccattctcaactacttgtaaatgccctgcccttgtttacactgctggtttacgcttttcctccaaaccattgtagcggatatctcctggtactatccccaatccgccactcttgactccctcttagagtggatagatgaactttgctgacagggcaccctccgatacttttaccctgatgaagtcctattctttacttttatactcactcttattctcattcccattcttatgccatcctctacctctccccagctatctccaccacactatcaatctcactcactctctcctagctgtttctaaaccttctttaacaaacaattgctggctttgcatttctctttcctctaaaatcacagaggcctcgacttactcactgctaaaaaaaaaaaaaaagggggactctgggccaggcgcagtggctcatgcctgcaatcccagcactttggaacactgaggtgggcagatcacgaggtcaggagatcgagaccatcctggctaacacagtgaaattctgtctctactaagaatacaaaaacttagctgggcgtggtggcgggtgcctgtagtcccagcttcttgggaggctgaggcaggagaatggtgtgaacccggaaggcggagcttgcagtgagccgagatcacgccactgcactccagcctgggcaacaaagcaagagtctgtctcaaaaaacaaaaacaaaaacaacaaaaaacattttttaaatgaagagtgttgtttttacctaaatcaatctggcctggtatatgacaacataaaaaaactcaaggatagagccccaaaactcgccaaccaatcaaataattacgctgaacccccttggacactctctaattggatatcctgggtcctcccaattcttagtcctttaatacctgtttttctccttctcttattaggaccttgtgtcttccgtttagtttcccaattcttacaaaaccgcatccaggccatcaccaatcattctatatgacaaatgctccttctaacaaccccacaatatcaccccctaccccaaaatctttcttcagtttaatctctcccactgtaggttcccatgccacccctaatcctgctcgaagcagcccagagaaacattgctcattatctctccacatcgcccctaaaaaattttcgccaccccaacacttcaccaccattttgttttgtttttcttattaatataagaagacaggaatgtcaggtctctaagcccaagctaaatcatcatatcctgtgacctgcatgtatacatccagatggcctgaagcaactgaagatccacaaaagaactgaaaatagccttaactgatgacattctaccat

SEQ ID NO: 180 - DNA, 451 bp, Homo sapiens
gtcaggcctctgagcccaagctaagccaccgtaacccctgtgacctgcacgtatacatccagatggcctgaagtaactgaagaatcacaaaagaagtgaaatgtaaatggcctgttcctgccttaactgatgacattccaccacaaaagaagtgaaaatggccggtccctgccttaactgataaccttgtgaaattccttctcctggctcatcctggctcaaaagctcccccactgagcaccttgtgaccccaccccgcccgccagagaacaacccccctttgactgtaactttcctttacctacccaaatcttataaaaacggccccacccctatctccctttgctgactctcttttcggacttagcccgcctgcacccaggtgaaataaacagccttgttgctcacacaaagcctgtttgatggtctcttcacatggacgcaagtgaaa

SEQ ID NO: 181 - DNA, 5720 bp, Homo sapiens
gtcaggcctctgagcccaagccaagccatcgcatctcctgtgacttgcacatatatgcccagatggcctgaagtaactgaagaatcacaaaagaagtgaaaaggccctgccctgccttaactgatgacataccaccattgtgatttgttcctgccccaccttaactgagtgattaaccctgtgaatttccttctcctggtacagaagctcccccactgagcaccttgtgaccccgcccctgcccaccagagaacaaccccctttgactgtaattttccattaccttcccaaattctataaaatggcccacccctatctcccttcgctgactctcttttcggactcagctctcctgcaaccaggtgaaataaacagccatgttgctcacacaaaccctgtttggtggtctcttcacacagacgcgcatgaaatttggtgccgtgactcggatggggggacctcccttgggagatcaatccccccgtcctcctgctctctgctccgtgagaaagatccacctatgacctcaggtcctcagaccgaccagcccaagaaacatctcaccaatttcaaatccggtaagtggcctctttttactctcttctccaacttccctcactatccctcaacctctttctcctttcaatcttggcgccacacttcaatctctcccttctcttaatttcaattcctttcattttctggtagaaacaaaggagacacattttatccgtggacccaaaactccggcgccggtcacggactgggaaggcagccttcccttggtgtttaatcattgcagggacgcctctgattattcacccacgtttcaaaggtgtcagaccatgcagggacgcctgccttggtccttcacccttagcggcaagtcccgcttttctaggggaggggcaagtaccccaaccccttctctccgtgtctctaccccttctctgattttctggggcaagggcaagaacccctcaaccccttctccttcccctcagtggcaagtcccgcttttctaggggaggtgcaagtaccccaaccccttctctccgtgtctctaccccttctctgcttttctggaggggggggcacgtaccccaaccttgtatctctgcaccctgatcccttatttccatgccccaacctcatatctctgcaccccgaccccttctctgcttttctggagggcaagaaacccccaccccttctccatgtctctactcttttctctgggcttgcctacttcactatgggcaagcttccaccttccattcctccttctcccttagcttgtgttcttaagaacttaaaacctcttcagctctcacctgacctaaaatctaagtatcttattttcttctgcaatgccacttgaccccaatacaaactcgacagtagttccaaatagccagaaaaacggcactttcaatttttgcatcctacaagatctaaataattcttgccgtaaaatgggcaaatggtctgaggtgcctgacgtccaggcattcttttacacatcggtcccttcctagtctctgtgcccagtgcaactcatcccaaatcttccttctttcccctcccgcctgtcccctcagtcccaaccccaagcatcactgagtctttctaatcttccttttctacagacccatctgacctctcccttcctcaccaggccaagctaggtcccgattcttcctcgcctccgcccctccaccctataatctttttatcgcctcccctcctcacacctggtctggcttacagtttcgttccgtgactagccctccaccacctgcccagcaatttactcttaaaaaggttgctggagccaaaggcatagtcaaggttaatgctcctttttctttatcccaaatcagaagtgtttaggctccttttcatcaaatataaaaacccagcccagtttatggctcgttccacagcaaccctgagacgctttacagccctagaccctaaaaggtcaaaaggccatcatattctcaatatacattttattacctaatctgctcccgacattaaataaaactccaaaaactggaatctggccctcaaaccccacaacaggacttcattaatctcaccttcaaggcgtacaataataaaaaaaaagttgcaattccttgcctccactgtgagacaaaccccagccacatctccagcacacaagaacttccaaacgcctgaaccacagcagccaggagttcctccagaacctcctcccacaggagcttgctacaagtgccagaaatctgaccaccaggccaaggaatgcctgcagcccaggattcctcctaagccgtgtccatctgtgcgggaccccactggaaatcggactgttcaactcacctggcaggcactcccagagcccctggaattctggcccaaggctctctgactccttctcggcttagcagctgaagactgacgctgcccgatcacctcgaaagccccatagatcatcacagacgctgagcttcgagtaactctcacagtggaaggtaagtccgtccccttaatcaatatggagcctacccactccacattaccttcttttcaagggcctgtttcccttgcctccgtaactgttgtaggtattgacggccaggcttctaaacctcttaaaactccccaactctggtgccaactgagacaatactcttctaagcactcttttagttatccccacctgctcagttcccttattaggccgagacactttaactaaattatctgcttccctgactagtcctggattacagctacatctcattgctgcccttcttcccaatccaaagcctcctttgcgtcctcctcttgtattcccccaccttaacccacaggaataagatacctctactccctccttggtaactgatcatgcaccccttactatctcattaaaacctaatcacccttaccccgctcaatgccaatatctcatcccacaccatgctttgaaaggattaaagcctgttatcacttgcgtgctacagcatggccttttaaagcctataaactctccttacaattcccccattatacctgtcctaaaaccagacaagccttccaagttagttcgggatctatgccttatcaaccaaattgttttgcctatccaccctatggtgccaaacccatatactctcctatcctcaatacctccctccacaatccattattctgttctggatctcaaacatgttttctttactattcctttgcacccatcatcccagcctctcttcgctttcagctggactgaccctaacacccattaggctcagcaaattacctgggctgtactgccgcaaggcttcacagacagcccccattacttcagtcaagcccaaatttcaccctcatctgttacctatctcagcataattctcataaaaacacaggtgctctccctgctgatcgtgtccaattaatctccccaacctcaatcccttacaaaacaacaactcctttccttcctaggcatggttagtgtggtcagaattcttacacaagagccaggaccgcaccctgtagcctttctgtccaaacaacttgaccttactgttttagcctagccctcatgtctccgtgcagcggctgctgccaccctaatacttttagaggccctaaaaatcataaactatgctcaacttactctctacatttctcataacttccaaaatctattttcttcctcatacctgatgcatatactttctgctccccggctccttcagctgtactcactctttgttaagtcccacaattaccattgttcctggcccagacttcaatctggcctcccacattattcctgataccacacctgacccccatgactgtatgtctctgatccacctgacattcaccacatttccccatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttccattgtagaaatctatcctcaaggaaataatttctcagtgttccatctgctattctatctgctattctactactcctcaaggattattcaggacccctcccttccctacacatcaaacttgaggatttgccccctgcccccgcccccggaactggcaaattagctttactcaacatgccctgagtcacaaaaactaaaatacctcttagtctaagtagacactttcactagataggtagaggcctttcctacagggtctgagaaggccactgcagtcatttcttcccttctgtcagacataatccctcagtttagccttcccacctctatacagtctgataacagaccaacctttattagtcaaatcagccaagcagtttttcaggctcttagtattcagtgaaacctttatatcccttatagtcgtctgtcttcaagaaaagtagaacggactaaaggtctttcaaaaacacacctcaccaagctcagccaccaacttaaaaagaactggacaatacttttaccactttcccttctcagaagtcagacccgtcctcagaatgctacaaggtacagcccatttgggctcctgtatagatgctcctttttattaggccccagtctcattccaaacaccggaccaacttagagtgtgccccaaaaaaaacttgtcatccctactatcttctgtctagtcatactcctattctccgttctcaactactcatacatgccctgctcttgtttacactgccggtttacactgtttctccaagccatcacagctgatatctcctcgtgctatccccaaaccgccactcttaactcttgaagtaaataaataatcttggctggcaggactatgctgaatctccttaggcactctctaatcagatgtcctaggtcctcccaattcttagaccttttatacctgtttttctccttctcttattccatttagtttttcaattcatacaaaaccgtatccaggccatcaccaatcattctaaatgacaaatgtttcttctaacaaccccacaatatcaccccttaccacaaaatcttccttcagcttaatctctcccactctaggttcccacgccgcccctaatcccgcttgaagcagccctgagaaacatcgtccattctctctccatatcacccccccaaaattttcaccaccccaagacttcaacactgttttatttttcttattaatataagaaggcaggattgtcaggcctctgagcccaagccaagccatcgcatctcctgtgacttgcacatatatgcccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccaaccctgcccaccagagaacaaccccctttgactgtaattttccattaccttcccaaatcctaaaaaacggccccacccctatctcccttcgctgactctcttttcagactcagcccgcctgcacccaggtgaaataaacagccatgttgctcacacaaaccctgtttggtggtctcttcacacaaacgcgcatgaaa

SEQ ID NO: 182 - DNA, 7257 bp, Homo sapiens
gtcaggtctctgagcccaagctaagccatcataacccctgtgacctgcacgtatacatccagagggcctggagcaactgaagaaccacaaaagatgacattccaccattgtgatttgttcctgccccaccccaactaatcaatcgatcttgtgacattcctcccctggaaaatgagtctcatgatctccccatcctgcaccttatgactcctgtggctgcctgcaagagataaccaccttcaactgtaattttccactatctacccaaatcctataaaaagtgccccaccccatctccctttgctgactccttttttgtactcagcccacctgcacctaggtgattaaaaagctttattacttgcacaaagcctgtctggtggtctcttcacacggactcatgtgacatttggtgctggagacccaggacagggagactccttcaggagactggtcccctgtcctcgcctctctttgtgaggagatccacctacaatgtcaggtcctcagactagcctaaggaacatctctccaattttaaattgggtaagcagccttttttattctcttctccaacctttctcactatccttccacccttcaatctctcccttccttaattttggttcctttccctttctggtagagacagaggagacgcgttttatctgtgaactcaaaactccggtgctggtcatggactcgggaagccagtcttcccttggtgtctaatcactgcagggatgcctgcctgattattcacccacattccaggtgtgtctgatcaccgcagggacccctgccttgatccttcacctttgtggcaagtactacctcccctgggtggcaagtaccacctccccttggtggcaagtaccacctcctgtgggtggcaagtaccacctccctccctccgtgtctctaccctatcttttctctaaacttacctttttactatgggcaaccttccgccctccattcctccatcttctcccttagcctgtgttccaaaaaacttaaaacctcttcaactctcacctgacctaaaacctaagcctcttattatcttctgcaataccacttggccccaatacaaactcggcagtggctctaaatggccagaaaatgacactttcaattcctccatcctacaagatctagataatttttgtcgtaaaatgggcaaatggcctgaggtgcctgatgtccaggcattcttttacacattggtccctccctagtatctgctcccaatgtgactcatcccaaatctttcttcattctcctttctctcctgtctgtcccttcagtctccaccccaagctctgagtcctttgaatcctccttttctacagacctatctgacctctcccctcctcctcaggctgctcctcgccaggccgagccaagtcccaattcttcctcagcctccactcccccaccctataatccttctatcacctcccatcctcacacccagtccagcttacagttttgctccgcgactagccctcccaacaatctcctcttggagaggtggctggagctgaaggcatagtcaaggttaaggctccttttctttatccaccctgtcccagatcagttagtgtttgggctagttttcatcaaatataaaaacccagcccagttcatggcccatttggcaacaacccttagacgctttactgccctagccccagaggggccagaaggctgtcttattctcaatatgcattttattaccaatctgctcctgacattagaaaaagctccaaaaattagattccagccctcaaaccccacaacaggatttaattaacctcgccttcaaggtgtacaataatagagaagaggcagtcaagcaacaacgtatttctgagttgcaattacttgcctccgctgtgagagaaaccccagccacatctccagcacacaagaacttcaaaatgcctaaactgcagcagccaggcattcctccaggacctcctccctcaggatcttgcttcaagtgctggaaatctggccactgggccaagaaatgcccgcagcccaggattcctcctaagccatgtcccatctttgtgggaccccactggaaatcggactattcaacttgcccagcagccactcccagagcccctggaactctggcccaaggctcttggactgactcctttccagatcttctcaccttagcgggtgaagactgacactgcccaattgcattggaaacctcctggaccatcacagatgctttgggtaacttttacagtggagggtaagtctctccccttcttaatcaatatggaggctacccactccacattaccttcttttcaagggcctgtttcccttgcctccataactgttgcaggtattgacggccaggctgctagaccccttaaaactccctcactctggtgccaacttggacaacattcttttatgcactttttcagttttccccacctgcccagttcccttattaggttgagacattttaactaaattatctgcttccatgactattcctggactacagccacatctcatcgctgcccttctccccaacccaaagcctcctttgtgtcttcctctcatatcccccaaccttaatccacaagtctgggacacctctactccctccctggcaaccgatcacatgcctattactatcccattaaaacctaatcacccttacccgctcaacaccagtatcccatcccacataggctttaaggggactaaagcctgttatcatctgcatgttacaacatggcctcttaaagcctacaaattctctttataactcccctatcctacccatccagaaaccagacaagtcttacaggttggttcaggatctttgccttattaatcaaatcgtccttcccatccatcctatagtgccaaacctgtacaccctcctatcttcaatacctccttccgcaattcactattccattcttgatcttaaagatgcttttttcactattcccctgcacccctcgtcccatcctctctttgcttttacctggactgaccctgatatccatcagtcccagtagcttacctgggctatactgccacaaggcttcagggaccgtcctcattagttcagccaagctctttctcatgatttactttctttccacccctctgcttctcaccttattcaatatattgatgaccttctactttgtagcccctcctttgaatcttctcaacaagacaccctcctgttccttcaacatttattctccaagggatatcgtgtatccccctccaaagctcaaatttcttcctcatctgttacctaccttggcataattcttcatgaaaacacaagtgcacttcctgccaattgtgtccagctgatctctaaaccccaaccccttctacaaaacaacaactcctttccttcctgggcatggttggatactttcacatttggatacctggttttgccatcctaacaaaaccattatataaactcacaatgggaaacctagctgacaccatagatcctaaatcctttccccactcctctttctgttccttaaaaacagctctggagactcctcccacactagctctccctgactcatcccaacctttttcattacacacaaccaaagtgcagggctgtgcagtcggaattcttacacaaggatcgggaccacgccctgtagcctttttgtccaaacaacttgaccttactgttttaggctggctctcatgtctgcatgcagcagctgctgctgctctaatacttttagaggccctcaaaatcacaaactatgctcaactcactctctacagttctcataactttcaaaaactattttcttcctcacatgtgacgcatatactttctgccccccagctccttcagctatactcactctttgttgagtctcctacaattaccattgttcctggcccggacttcaatccagcctcccacattattcctgataccacacctgatccctatgactgtatctctctgatccacctgacattcactccattacccatatttccttctttcctgttcctcaccctgatcacacttggtttattgatggcagtaccaccaggcctaatcacaattcaccagcaaaggcaggctatgctatagtatcttccacatctatcattgaggctaccactctgccccactccactacctctcagcaaaccaaactcctagacttaactgaagccctcactcttgcaaaatgactgcatgtcaatatttatactgactttatatatgccttccatatcctgcaccaccatgctgttatatgggctgaaagaggttttctcactacgcaagggtcctccatcattaatgcctctttaacgaaaactcttcacaagcctgctttacttccaaaggaagctggagtccttcactgcaaaggccatcaaatggcctcagaccccattgctcaaggcaacaattatgctgataagacagcaaaagaagcagccagtattcctacttctttcactcacggccggtttttctctttctcatcagtcattcctacttactctcccactgaagtttccacctatcaatccctccccactcaaggcaaatggttcttggaccaaggaaaatatctccgtccagcctcagaggcccattctattctgtcatcctttcataacctcttccatgtaggttacaagccactagcccatctctcagaacctctcatttcctttccatcatggaaatctatcctcgaggaaatcacttctcagtgttccatctgctattctactactcctcagggattgttcaggccccctcctttccctacacatcaagctcaggggtttgcccctgcccaggactgggaaattgactttactcctgggaaactccaggaaacttggagtttcctgctccaagtcaggaaactaaaatacctcttggtctgggtagatactttcactggataggtagaggtctttcctacagcatctgagaagaccaccattgtcattttttcccttctatcagacataattcctcagtttggccttcccacctctatacagttcaataatggactggcctttattagtcaaatcacccaagcaatttctcaggctcttggtattcagtggaaccttcataccccttagcatcctcaatcttcaggaaaggtagaacagactaatggtcttttaaagacacacctcaccaagctcagtgaccaacttaaaaaggactggacagtacttttacctcttgcccttctcagaattagtctgtcctcgagatgctacagggtacagtccacttgaacttttatatggacgcactttcttgctcagccccaacctcgtcccagacaccagctctctagatgactatcttccagtcctccagcagatgagacaggaaattcaccaggctgctagtcttctcttgcctactccagattctcagccatatgaagacaccctagctgaacgatcagttcttgttaagaatctgacccctcaaactctacaacctcaatggaccggaccctgcttagtcatctatataccccaactgcaggcctgcaggaccctctccattcctgttctagtgattgcccccctccatatcactgttccagaataaagctgtatctgtcagccagccagcctgatctctcctcttcctcctggaagtcgcaagtactcacccctacttcccttgaactcagtttcatttctgaagaacagtaataacacttatgagcctaatacatctcttcattctattacgtctattcatccttaccctactttttgcaacagggctttacatagtcacccccactacttggaccgcaccctaaaaacttgtcatccctactatcttctgtctagtcatactcctattcaccattcccaactactcataaatgccctgcccttgtttacactgccagtttacactttttctctaaaccatcataactgatatctcctagttttacctcaaactgccattcttgactccctcttggagtgggtaggtgatctttgctgacagggcaccctccaatactttcaccctgatgaagtcctattctttacttgtatactcactcttattctcgttcccgttcttatgccaccctctacctctccccagctatctccaccacactatcaatctcactcactctctcctagctgtttctaatccttctttaacaaacaattgctggctttgcatttctctttcctccaaaaccactgaggcctcaacttactcactgctaaaaaaaaaaaaaagaggactctgtatatttttaaatgaagaatgttgtttttacctaaatcaatctggcctggtatagaaaaacataaaaaaaaaaaaaaacaaactcaaggatagagccccaaaactcgccaaccaagcaaataattatgctgaacacccttggatactctctaattggttgttctgggtcctcccaattcttagtcctataatacctgtttttctccttcttttattcagaccttgtatcttccatttagtttctcaattcatacaaaactgcatccaggccatcaccaatcattctatatgacaaatgctccttctaacaaccccacaatatcaccccttaccgcaaagtctttcttcagtttaatctctcccactcaagttcccacattgcccctaatcctacttgaagcagccctgagaaacatcacccattatctctccataccacccccaaaattttttgctgccccagcacttcaccactattttgttttgtttttcttactaatataagaagacaggaatgtcaggcctctcagcccaagctaagccatcataacccctctgacctgcatgtatacatccagagggcctggagcaactgaagaaccacaaaagatgatattccaccattgtgatttgttcctgccccactccaactaatcaatcgaccttgtaacattcctcccctggacaatgagtctcatgatccccccatcctgcaccttgtgaccaccgcccctgcctgccctgcaagagataaccacgtttaactgtaattttccactacctacccaaatcctataaaactgcctcacctctatctccctttgctgactctctttatggactcagcccacttgcacccaagtgaaataaacagccttgctgctcacacaaagcctgttggtggactctcttcacatgtacttgcgtga

SEQ ID NO: 183 - DNA, 713 bp, Homo sapiens
tcaatccatcaagaccctttcacgtggaaccccttaaagctgtaagcccttaaacgggccaggaactctgtcttccttccgggagctcggctcttaagacgcgagtctgccgaagctcccagcggaataaaaaaaactcttccttctttaatccgctgtctgaggggttttgtccgctgctcatccatgctccatttctttgttccctgaccgggaatcgaacgcaggcagcagcggtgagagcaccgaatcctaagcactagaccaccaggggaacttagaaccttgtgggaaatagattgcgcaccattagaagtgggttggccatcagaaggaagcctggacaggtcccttgtttctaaggcgtggcacaaggtaactggtaaagatacctagaccagttcccatacatagacacttggtgacagctggtgctagaacccccacagtggctgagggcatgcagcagcaatactagtagcaaagggacagatagctaaggaaggatcccgctccactcacccagggaaatcaactcctgaagttctgttcgaccccacatcagaggatccattgcaggagatggcaccagagatcccagtggtgtcctccccttaacagggaaagaggctccccactcttgagcccacagtgcttgtgcctccacaagacaagcatatccctaggccacccagagtagacaagagaggagg

SEQ ID NO: 184 - DNA, 5792 bp, Homo sapiens
agccatcatatcccctgtgacctgcaggtacacatccagatggctggttcctgccttaaatgatgacattccaccacaaaagaagtgaaaatggtcagttcctgccttaactgatgacattatcttgtgaaattccttcccctggctcatcctggctcaaaagctcccctactgagcaacttgtgacccccccactcctgcccgccagagaacaacacccctttttcctttaccgacccaaatcctataaaacggccccaccccatctcccttcgctgactctcttttcagactcagcctgcctgcaccctggtgattaaaaaactttattgttcacacaaagcctgtttggcaatctcttcatacagatacgagtgaaatttggtgctgtgactcggattgggggacctcccttgggagatcaatccctgtcctcctgctctttgctccttgagaaagatccacctacaacctcaggtcctcagactgaccagcccaagaaacacctcaccaatttcaaatctggtaatcggcctctttttactctcttctccaacctccctcactatccctcaaactctttcacctttcaatcttggtgtcacacttcaatctctcccttctcttcatttcaattcctttcattttctggtagagacaaaggagacgcgttttatccatggacccaaaactctggcgccggtcacggactgagaaggcagccttcccttggtgtttaatcactgcagggacgcctctctatacacccacgtttcagaggtgtcagaccatgcagggatgcctggcttggtccttcacccttagtggcaagtcccacttttctgggagaggggcaagaacccctcaaccccttctccttcacccttagcagcaagtcctgcttttctagggggcaataacccccaatcccttatttccgcgccctgacctcttatctctgtgcctcgatcccttatttctgcaccccaacctcctatctctgcaccccaaacccttatttctgtgctccgaccccttctctgcttttctggagggcaagaacgccacaccccttctctgtgtctctactctcttttctctgggcttgcctccttcactatgggcaagcttccaccttccattcctctttcttctcccttagcctgtgctttcaagaacttaaaacctcttcaactctcacctgacctaaaatctaagcatcttattttcttctgcaatgccacttcaccccaatacaaactcgacagtagttccaaatagccagaaaacagcactttcaatttttccatcctacgagatctaaataattcttgtcgtaaaataggcaaacactctgagatgcctgacgtccaggtattcttttacacattggtccctccctagtctctgttcccaatgcaactcatcccaaatcttccttctttccctcccatctgtcccctcagtcccgaccccaagtgttgctgactctttctaatcttccttttctacaaacccatctgacctctcctctgctcgccaggctgtgctaggtcccaattcttcctcagcctctgctcctccaccctataatccttttatcacctcccctcctcacacccagtccggcttacagtttggttccatgactagccctgccccatctgcccagcaatttactcttaaaaaggtggctggagctaaaggcatagtcaaggttaatgctcctttttctttatcccaaatcagatagcgttcagcctctttttcatcaaatataaaaattcagcccagttcatggctcatttggcagcaaccctgagatgctttacaaccctagaccctaaaaggtcaaaaggccgtctattctcaatatacattttattaccctatctgctcccaaaattaaataaaactccaaaaattaaattccggccctcaaaccccacaacaggacttaacctcaccttcaaggtgtgtaataatagagtagaggcagccaagtagcaacatatttctgagttgcaattccttgcctccactgtgagacaaaccccagccacatctccagcacacgagaacttccaaatgcctaaaccgcagtggccaggcattcctccagaaccatctcccccaggagcttgctacaagtgccagaaatctggccagcaggccaaggaatgcctgcagcccaggattcctcctaagtcgtgttccatctgtgcaggaccccactggaaatcagactgttcaactcagctggcagccactcccagagcccctggaactctggcccgaggctctctgactgactccttcccagatcttcttggcttagtggctgaagactgacgctgaccaattgcctcggaagccccgtagaccatcacggacgccaacctttaggtaactctcacagtggacggtgagtctgtccccttcttaatcaatacagaggctacccactccacattaccttcttttccagagcctgtttcccttgcctccataactgttgtgggtattgacagccagccttctaaacctcttaaaagtccccaactctggtgccaacttagacaatactcttttaagcactcctttttagttatccccacctgcccagttcccttattaggccgagacactttaactaaattatctgcttccctgactattcctggactacagctgtatctcactgccacccttcttcccaatccaaagcctcctttgtgtcctcctcttgtatcccctgaccttaacccacaagtataagatacctctactccctccttggtgacctatcatgcaccccttaccatctcattaaaacctaatcacccttaccccactcaatgccaatatcccatcccacagcatgcttcgaaaggattaaagcctgttatcactggcctgctacagcatggccttttaaagcctataaactctccttacaattcccccattatacctgtcctaaaaccagacaagccttacaagttagttcaggatctgcgcattatcaaccaaattgttttgcctatccaccccatggtgccaaacccatatactctcctatcctcaatacctccctccacaatccattattctgttctggatctcaaacattctttctttactattcctttgcacccttcatcccagcctctctttgctttcacttggactgaccctgacacccatcaggctcagcaaattacctaggctgtactgccgcaaagcttcacagacagcccccattacttcagtcaagcccaaatttcatcttcctctgttacctatctcagcataattctcataaaaacacacgtgctctccctgctgatcgtgtccaactaatctctcaaaccccaaccccttctacaaaacaacaactcctttccttcctgggcatggttggatactttcacctttggatacctggttttgccatcctaacaaaaccattatataaactcacaaaaggaaacccagctgaacccatagatcctaaatcatttccccatcctctttccattccttgaagacagctttagagactgcccccaccctagctctccctgactcatcccaacccttttcattacacacagctgaagtgcagggctgtgcagttggaattcttacacaagaaccgggatcacgtcctgtagcctttttgtctaaacaacttgaccttactgttttaggctggccatcatgtctccgtgcagtggctgctgccactctaatacttttagaggcccttataatcacaaactatgctcaactcactctctagagctctcataatttccaaagtctgttttcttcctcacacctgacacatatactttctgctccctggctccttcagctatactcactatttgttgagtctcccacaattaccattgttcctggcctggacttcaatccggcctcccacattattcctgataccacacctgaccctcatgactgcatctctctgatccacctgacgttcaccccatttccccacattctcttcttccctgtttctcaccctgatcacacttgatttattgatggcagttctacaagacctaatcaccacacagcagcaaaggcaggctatgctatagtacaagccactagccggcctcttagaacctctcatttcctttccattgtagaaatctatcctcaaggaaataacttctcagtgttccatctgctattctactactcctcagggattattcaggccccctcccttccctacacatcaagctcagggatttgccccctcccaggactggcaaattagctttactcaacatgccctgagtcaggaaactaaaatacctcttggtctcagtagacgctttcactggacaggtagaggcctttcccacagggtctaagaagaccaccatggtcatttcttcccttctgtcagacataattcctcggtttggccttcccacctctatgaagtctgacagcagaccggcctttattagtcaaatcagccaagcattttttcaggctcttagtgttcagtgaaacctttatatcccttacagttctcagtcttcaggaaaggtagaaaagactaatggtcttttaaaaacacacctcaccaagctcagccatcaacttaaaaaggaccggacaatacttttaccactttcccttctcagaattcaggcctgtcctcagaatgctataaggtacagcccatttgagctcctatatagacgctcctttttattaagccccagtctcattccagacaccagaccaacttagactgtgtcccaaaaaacttgtcatccctactatcttccatctagtcatacacctattcaccattctcaactattcatacatgccctgctcttgtttacactgcaggtttacactgtttctccaagccatcatagctgatatctcctggtgctatccccaaactgccactcttaactcttaaagtaaacaaataatctttgctggcaaggctatgctgaacctccttaggcactctctaattagatgtcctaggtcctcccaattcttagtcctttaataacctgtttttctccttctcttattccgtttagtttttcaattcatacaaaactgtatccaggccatcaccaataattctaaatgacaaatgtttcttctaacaaccccacagtatcaccccttaccacaaaatcttccttcagcttaatctctcccactctaggttcccacgctgcccctaatcctgcttgaagcagccctgagaaacatcgcccattatctctccataccaccccccaaaaatgttcaccatcccaacactttaccactatttcattttattttacttattaatataagaagacaggaatgtcaggcttctgagcccaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccacttctgcccgccagagaacacttctgccccctttttcctttacctacccaaatcctataaaacagccccacccctgtctcccttctcgctcttttcggactcagcccgcctgcatccagctaattaaagagctttattgctcacacaaagcctgtttggtggtctcttcacacagacacgagtgaaa

SEQ ID NO: 185 - DNA, 5738 bp, Homo sapiens
gaaaaattgcctaataatttgtctgctcaaatgtgcgggctgtttgcactcagccaagccttaaagtacttacagaatcaaaagactatctcaatcctgactcaaaaggttacctacaccctctctgaaacaaatttgcataagaactgcttttacgggaacgcatcttgatggcgcagctgggttgttaggaaatactcaggaacccagcccagctctaggactcacctctgagtgcaaaggcaatgttgggcatgctggtaaaggaccactagaatccagcagtgtggactgctttctttgtggtcaagaaaggtgggaaaacaggtgcaggacttctacattggtcagcttaactaatccgataagcagaggtccatgggtggttacgcaccatggaaaggaactcacctctgagcgcaaaggcaatgctgggcatgctggtaaaggaccactagaatccagcagcccaggcccctttctttatggtcaagaaaggtgggaaaaggtgtgcaggactgctacatcggtgagcataactaatctaataagcagaggtccatgggtggttatgaaccctggaaaggaataagcattaggaccatagaggatgctctatgactaatgctcatcagaaaatgactagggatgctggcatccctgttattttttcagatgggaaatgttcctcccaaggcaaaaacacccctaagatgtattctggagaactgggaccaatttgaccctcagacactaagaaagaaacaacttatattcttctgcagtgccgcctggccatgttatcctcttcaagggggagaaatctggcctcctgagggaagtatacattataacaccatcttacagctagacctcttttgtaggaaaaaaggcaaatggattgaagtgccatatgtacaaactttcttttcattaagagacaactcacaattatgtaaaaagtgtgatttatgccctataggaagccctcagagtctacctccctaccccagtgtccccccgactccttctccaactaataagacctgtcttcaacccaaatggtccaaaaggagatagacaaaggggtaaacgatgaaccaaagagtgccaatattccccgattatgccccctccaagcagtgggaggaggagaattcagcccagccagagtgaatgtacctttttctctctcagacttaaagcaaattaaaatagacctaggtaaattctcagataaccctgatggctatattgatgttttacaaggattagggcaatcctttgatctgatatggagagatataatgctactgctagatcagacactaaccccaaatgagagaagtgctgccataactgcagcccaagagtttggcagtctctggtatctcagtcaggtcaatgacaggatgataacagaggaaagagaatgattccccacaggccagcaggcagttcccagtgtagaccctcactgggacacagaatcagaacatggagattggttctgcagacatttgctaacttgcatgctacaaggactaaggaaaactaggaagaagcctatgaattattcaatgatgtccactataacacagggaagggaagaaaatcctactgcctttctggagagactaagggaggcattgagaaagcatacctccctgtcacctgactctattgaaggccaactaatcttaaaggaaaagtttattactcagtcagctgcagacattaggaaaaaacttcaaaagtccaccttaggcccggagcaaaacttagaaaccctattgaacttggcaacctcggttttttataatagcgatcaggaggaacaggcagaatgggacaaacaggataaaaaaaagaccaccgctttagtcatggctctcaggcaagtggactttggaggctctggaaatgggaaaagctaggcaaatggaatgcctaatagggcttgcttccagtgcagtctatggggatactttaaaaaagattgtccaagtaggaataagccacgcccttgtccacgctccttatgtcaaaggaatcactggaaggcccagtgccctaggggaggaaggtcctctgagtcagaagccactaaccagatgatccagcagcaggattgagggtgcccagggcaagcaccagcccatgccatcaccctcacaaagccccgggtatgcttgaccattgagggccaggaggctaactgtgtcctggacattggcgtggccttctcagtcttactctcctgtcctggacaactatcctccagatctgtcactatccgaggggtcctaggacagccagtcactagctacttctcccagccactaagttgtgactggggaactctactcttttcacatgcttttctaattatgcctgaaagccccactcccttgttagggagagacattctagcaaaagcaggggtcattatacacccgaacataggagaaggaacacccatttgttgtcccctgcttgaggaaggaattaatcctgaagtctgggcaacagaaagaaaataaggaagagcaaagaatgcctgtcctgttcaagttaaactaaaggattccacctcctttccctaccaaaggcagtacccccttagacctgaggcccaacaaggactccaaaagattgttaaggacctaaaagcccaaggcctagtaaaaccatgcattcgcccctgcaatactccaattttaggagtacagaaacccaatggacagtagaggttagtgcaagatctcaggattatcagtgaagccattgtccctctatacccagctgtacctaacccttacactctgctttcccaaataccagaggacgcagagtggtttacagtcctggaccctaagcatgccgttttctgcatccctgtacatcctgactctcaattcttgtttgcctttgaagatccttcaaacccaatgtctcaactcatctggactgttttaccccaagggttcaggaatagcccccatctatttggccaggcattagcccaagacttgagccaattctcctacctggacactcttgtccttcggtacatggatgatttacttttagccacccattcagaaaccttgtgccatcaagccacccaagcactcttaaatttccttgctacctgtggctacaaggtttccaaaccaaaggctcagctctgctcacagcaggttaaatacttagggctaaaattatccaaaggcaccagaaccctcagtgaggaacgtatccagcctatactgggttatcctcatcccaaaaccctaaagcaactaacagcgttccttggcataacaggtttctgccaaatatggattcccaggtacagcaaaatagccagaccattaaatacacgaattaaggaaactcaaaaagccaatacccatttagtaagatggacacctgaagcagaagtggctttccaggccctaaagaaggcgctaacacatgccccagtgttaagcttgccagtggggcaaaacttttctttatatgtcacagaaaaaaacaggaatagctctaggagtccttacacaggtccaagggatgagcttgcaacccgtggcatacctgagtaaggaaattgatgtagtggcaaagggttggcctcattgtttacaggtagtggtggcagtagcagtcttggtatctgaagcagttaaaatgatacagggaagagatcttactgtgtggacatctcacaatgtgaatagcacactcactgctaaaagacacttgtggctgtcagacaacaatttacttaaatatcaggctctattacttgaagggccaatgctgcaattgcacacttgtgcaactcttaacccagccacatttcttccagacaacaaagaaaagatagaacataactgtcaacaagtaattgctcaaacctgtgctgctcaaggggaccttttagaggttcccttgactgatcccgacctcaacttgtatactgatgaaagttcctttgtagaaaaaggactttgaaaagtggggtatgcagtggttggtgataatggaatactcgaaagtaatccccttactccaggaactagtgctcagctggcagaactaatagccctcactcgggcaccagaattaggagaaggaaaaagggtaaatatatatgcaaactgtaagtaggcttacctagtcctccatgcccatgcagcaatagggagagaaagggaattcctaacttccaagggaacacttgtcaaacatcaggaagccattaagagattattattggctgtacagaaacctaaagaggtggcagtcttacactgctggggtcatcagaaaggaaaagaaagggaaatagaagagaaccgccaagcggatattgaagccagaagagccgcaaggcaggaccctccattagaaatgcttacagaaggacccctagtatggggtaatcccctctgggaaaccaagccccagtactcagaagaagacatagaatggggaacctcacaaagacatagtttcctcccctcaggatggctagccactgaagaaggaaaatacttttgcctgcagctaaccaatagaaattacttaaaacccttcaccaaaccttccacttatgcattgatagcatgcatcagatggccaaattattatttactggaccaggccttttcaaaactatcaagcagatagtcagggcctgtaaagtgtgccaaagaaataatcccctgcactgcaggccatacaggacaatccctgtatgtttaacctccttgttaagtttgtctcttccagaatcaaagctgtaaaactacaaatggctcttcaaatggagccccagatgcagtccatgactaagatctactgtggacccctggaccggcctgctagcccatgctccaatgttaatgacattgaaggcacccctcccgaggaaatctcaactgcacaacccctactatgccccaattcggcaggaagcagttagagtggtcgccagccaacctccccaacagcacttggttttcctgtttagagggggtactgagagacaggactagctggatttcttaggccagctaaaaatccctaagcctagctgggaaggggactgcatccacctttaaacagggggcttgcaacttagctcatacccaaccaatcagagagctcactaaaatgctaattaggcaaaaacaggaggtaaagaaacaaccaatcatctatcacctgagagcacaacaggagggacaatgatcgggatataaacccaggcattcgagctggcaatggctacggctcgagctgagctttcactcgccatccaccactgctgtttgccgccgccaccgcagacccgctgctggcttccatcccttcggatccggcagggtgtctgctgcattcctgatccagcgaggtgcccattgccactcccgatcgggctaaagacttgccactgttcctgcatggctaagtgcctgggttcgttctaatcaagctgaacaccagtcattgggttccacagttttcttcggtgacccacggcttctaatagagctataacactcaccgcatggcccaagattccattccttggaatccgtaaggccaagaaccccaggtcagagaaaacgaggcttgccaccatcttggaagcggcctgctgccattttggaagtggcccaccaccatcttgggagctctgggagcaaggacccccggtaaca

SEQ ID NO: 186 - DNA, 972 bp, Homo sapiens
gtggggaaaagaaagacagatcagattgttactgtgtctgtgtagaaagaagtagacataggagactccattttgttctgtactaagaaaaattcttctgccttgagatgctgttaatctgtaaccctacccctaaccctgtgctccctgaaacatgtgctgtgtccactcagggttaaatggattaagggttgtgcagggtgtgctttgttaaacaaatgctggaaggcagcatgctcgttaagagtcatcaccactccctaatctcaagtacccagcgacacaaaatactgcagaaggccacagggacctctgcctaggaaagccaggtattgtccaaggtttctccccatgtgatagtctgaaatatggcctcgtgggaagggaaagacctgaccgtcccccagcctgacaccagtaaagggtctgcgctgaggagtattagtaaaagaggaaggaacgcctcttttcagttgagacaagaggaaggcttctgtctcctgcccgtcccggggcaatggaatgtctcggtgtaaagccgattgtatattccatctactgagataggggaaaactgccttagggctggaggtgggacatgatggcagcaatactgctccttaaggcattgagatgtttatgtatatgcatatcaaaagcacagcagttttttctttaccttgtttatgatgcagagacatttgttcacgtgtttaccttctgaccttctctccactattatcgtattatcctgccacgtccccctctccgggaaacgcccgataatgatcaataaatactaagggaattcagaggctggtgccggcgtggatcctccgtatgctgaatgccggtcccctgagcccctttttctttctctatactttgtctctgtgtctctttcttttcctagtctctcgttccacctaacgagaaacatccgcaggtgtggaggggcaacccaccccttca

SEQ ID NO: 187 - DNA, 963 bp, Homo sapiens
gtggggaaaagaaagagagatcagattgttactgtgtctgtatagaaagaagtagacgtaggagactccattctgttctgtactaagaaaaattctgccttgagattctgttaatctgtgaccttacccccaaccctgtgctccctgaaacgtgtgctgtgtcaactcagggttaaatggattaagggctgtgcagggtgtgctttgttaaacagatgcttgaaggcagcatgctccttaagagtcatcaccactccctaatctcaagtacccagggacacaaacactgcggaaggccgcagggacctctgctgaggaaagccaggtattgtccaaggtttctccccatgtgatagtctgcaatatggcctcatgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccaatttacgttccatctactgagatagggaaaaaccgccttagggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgactctctccccgctattgtcttgtgaccctgacacatccccctctcggagaaacacccacaaatgatcaataaatactaagggaactcagaggctggcgggatcctccatatgctgaacgctggttccccgggcccccttatttctttctctatactttgtctctgtgtctttttcttttccaagtctctcgttccacctaacgagaaacacccacaggtgtggaggggcaacccaccccttca

SEQ ID NO: 188 - DNA, 6629 bp, Homo sapiens
gtcaggcctctgagcccaagcctgcacatatacatccagatggcctgaagtaactgaagaatcacaaaagaagtgaaaatggctggttcctgccttaactgatgacattaccttgtgaaattccttctcctggctcagaggctcccccactgagcaccttgtgaccccctcccctgtctgccggagaacaaccccctttgactataattttccactacctacccaaatcttataaaatggccccacccctatctctctttgctgactctctttttggactcatcctcctgcacccaggcgattaaaaagctttattgctcacacaaagcctgtttggtggtctcttcacatggacgcacatgacatttggtgctgtgactcagatcgggggacctccctcgggagatcaatcccctgtcctcctgctatttgctccatgagaaagatccacctacgacatcgaatcctcagaccaaccagcccaaggaacatctcaccaattttaaatcaggtaagcggcttctttttactctcttctccaacctctctcactatccctcaacttctttctcctttcaatttctgtgtcacccttcaatctctcccttcatttcaatccctttccttttctggtagagacagaggagacacgttttatctgtgaacccaaaactccagcgccagtcatggacttgggaagacagtcttcgcttggtgtttaatgactgaggggatgcctgcttgattattcacccacgtttcagaggtgtctgatcactgtggggacgcctgccttgatccttcacccttagtggcaagtatcactttcctgggggggggcaagcaccccccaccccttatctctgtgtctctaccctctctttactctgggcttatctccttcactatgggcaaccttccaccctccattcctccatcctctcccttagcctgtgttctcaagaacttaaaacctcttcaactcacacctgacctaaaacctaaacaccttattttcttctgcaatgctgcttaaccccaacacaaactcgacaatggttccaaatagccagaaaatggcacttttgatttttacatcctacaagatctagataattcttctcataaaatgggcaaatggtctgaggtgcctgacgtccaggcattcttttacacatcagtctcttcctaatctctgctcccagtgcgactcatcccaaacctttcttctttccctcccacctgtccccacagtcccaaccccaagcgttgctttcaatcttccttttctaccgacccatctgacctctcccttcatcccaagattgctcctcctcaggtaactccccgccaggctgagtcaggctccaattcttcctcagcttccgctcctccaccctataatccttctatcacctcctctccccacacccagtctggcttacagttttgttccgcgactagccctcccccacctcccaacaatttccttttaaaaatggtggctagagctaaaggcatagtcaaggttaatgctcctttttctttatccgacctctcccaaatcagttagcatttaggctttttttcgtcaaatatgaaaacccagcccagtgcatggctcatttggcaacaaccctgagacgctttacagccctagaccctgaaaggtcagaaggccgtctcattctaaatatgcattttattacccaatctgctcccaacattaaataaagctccaaaaattagattctggccctcaaaccccacaacaggacttaacctctccttcaaggtgtacaataatagagaagagttgcaattacttgcctcttctctgagagaaagcctagccacatctccagcacacaagaacttcaaaatgcctaaaccacagtggccaggtgttccttcaggacttcatccctcaggatcttgcttcacgtgctggaaatctggccactgggccaaggaatgcctgtggcccgggatccctcctaagctgtatcccatctatgagggactccactggaaatcggactgtccaactcacctggcaaccactcccagagcccctggaactctggcccaagactctctgactgactccttcccagatcttctcagcttagcagctgaagactgaagctgcccgatcacctcagaagcctcctggaccatcaaagatgctttaggtaactcttacagtggagggtaagtccgtccccttcttaatcaatacagaggctacccactccacattaccttcttttcatgggcctgtttcctttgcctccataactgttgtgagtattgatggccaggcttctaaacctcttaaaactccccaactctggtgccaactaggacaacattcttttatgcactcccttttagttatccccacctgcccagttcccttattaggccgagacattttaactaaattatctgcttccctgactattactgggctacagccacacctcattgccactcttttccccagttcaaagcctccttcgcatcctccccttgtatctccccatcttaatccacaggtatgggatgcctctactccctccctggcaaccacacgcccattactatcccattaaaacctaataacccttaccccactcaatgccaatgccaatatccatcccacaggaggctttaaaaggattaaagcctgttatcactcgcctgttacagcatggccttttaaagcctataaactctccctacaattcccccattttacctgtccaaaaactggacaaatcttacaggttagttcaggatctgcaccttatcaactaaattgttttgcctatccaccctgtggtgcctaacacatacactcttttgtcctcaataccttcctccacaactcactattccattcttgatcttaaagatgcttttttcactattcccctgtaccccttgtcccagcctctctttgcttttacctggactaaccctgacacccatcagtcccagcagcttacctggggtgtactaccacaaggcttcagggacagccctcattacttcagccaagctctttctcataatttactttctttccacccctctgcttctcaccttattcaaaatattgatggccttctactttgtagctcctgctttgaatcttctcaacaagacaacctcctgctccttcaacacttattctccaagggatatccagtatccccctccaaagctcaaatttcttctctgttacctacctcggcataattcttcataaaaacacacataccctccctgccaatcatgtctgactgatgtctcaaaccccaaccccttctacaaaacaactcctttccttcctgggcatggttagatacttttgcctttggatatctggttttgccatcttaacaaaaccgttatataaactcacaaaaggaaacctagctgaccctgtagatcctaaatcttttccccactcctcctttcattccttgaagacagctttagagactgctcccacactagctcttcctgactcatcccaaccctcttcattacacacagtggaagtgcagggctatgcagtgggaattcttacacgaggactgggaccgcaccctgtagcctttttgtccaaacatcttgaccttactgttttaggctggccatcatgtctccatgcagcagctgccactgccctaatacttttaaaggccctcaaaatcacaaactatattcaactcattctctacagttctcataacttccaaaatctgttttctttctcacacctgatgcatatactttctgctccccggctccttcagctatattcactctttgttgagtctcccacaattaccattgttcctggcctggacttcaatccagcctcccacattattccggataccacacctgacccccatgactatatctctctgatccacctgacattcacttcacttctccatatttccttctttcctgttcctcaccctgatcacacttggtttattgatggcagttccaccaggcctaattgccactcaccagcaaaggcaggctatgctatagtatcttccacatctatcattgaggctactgctctgcccccctccactacctgtcagcaagccgaactcattgccttaacttgagccctcactcttgcaaagggactatgcatcaatatttatactgactccaaatatgccttccgtatctttcaccaccatgctgttatatgggcagaaagaggtttcctcactacacaagcgtcctccatcattaatgcctctttaataaaaactttacttacaaaggaagctggagtcattcactgcaagggccatcaaaaggtatcagatcccatcactcagggcaatgcttatgctgataaggtagctaaagaagcagctagcattccaacttctgtccctcatggccagtttttctccttctcattgttcactcccacctactctttcactgaaacttccacctatcaatctcttcccacacaaggcaaatggttcttggaccaaaggaaatatctccttccagcctcacaggcccattctattctgttgtcatttcataacctcttccacgtaggttacaagccgctagcctgcctctcagagcctctcatttcctttccatcgtggacacctatcctcaaggaaatcacttctcagtgttctatctgctattctactgctcctcagggattgttcaggccccctcccttccctacacatcaagctcggggatttgcccctgcccaggactggtaacctgactttactcacatgccctgagtcaagaaactaaaatacctcttagtctaggtagacactttcactgaatgggtagaggcctttcccacagggtctgagaaggccaccacggtcatttcttcccttctgtcagaagtaattcctcggtttggccttcctacctctatacagtctgataacaaaccagcctttattagtcaaatcacccaagcagtttctcaggctctcagtattcagtgaaaccttcataccccttaccgttctcaatcttgaggaaaggtaaaacggactaatggtcttttaaaaacacacctcaccaagctcagccttcaacttaaaaaggactgggcaatacttttaccacttgcccttctcagaattcgggcctgtcctcgggatgctacagggtgcaacccatttgaattcctgtacgaacgctcctttttattaggccctggtctcattccagataccaacccaacttggactgcgccccaaaaacttgtcatccctactatcttctgtctagtcatactcctattcactattctcaactactcttaaatgccctgctcttgtttacactgccagtttacactgtttctccaagccatcacagctaatatctcctggtgctatctccaaaccgccactcttaactgcctcttagagtggacagatgatctttgctgacaaggtacactacaatactctcaccctgatgaaatcctattctttacttttatactcactgttattcttgttcctgttcttatgccaccctctacctctccccagctatctccaccgcactatcaatctcactcactctctcctagccatttataatccttctttaacgaacaattgctggctttgcatttctctttcctccaaaatctcggaggcctcgacttactcactgctaaaaaaaaagaggactctgtatgtttttaagtgaaaagtgttgtttttacctaaatcaatctggcctggtgtatgacaacataaaaaaaactcaaggatagagcccagaaactcaccaaccaagcaagtaattacgctgaacccccttgggcactctctaattggatgtcctgggtcctcccaattcttagtcctttaatacctgtttttctctttctcttattcagaccttgtgtctttcatttagtttctcaattcatacaaaaccatatccaggccatcacgcatcattctatatgacaaatgtttcttctaacaaccccacaatatcaccccttaccacaaaatcttccttcagcttaatctctcccactctaggttcccatgccaccccaatcccactcgaagcagccctgagaaacatcatccattatctctccatatcacccccaaaaattttcgctgccccaacactttaccactatttcgttttatttttcttattaatataagaagacaggaatgtcaggcctctgagcccaagcctgcacatatacatccagatggcctaaaggcctaaaagtaactgaagaatcacagaagaagtgaaaatggccggttcctgccttaactgatgacattaccttgtgaaattccttctcctggctcagaggctcccccactgagcaccttgtgacccccacccctgcctgccagagaacaaccccctttgactataattttccactacctacccaaatcctataaaatggccccaccccatctcccttctctgactctctttttggacacagcccgcctgcaactaggtgattaaaaactttattgctcacacaaagcctgtttggtggtctcttcacacagatgcacgtgaaa

SEQ ID NO: 189 - DNA, 5856 bp, Homo sapiens
gccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatctgtggatccaaaactccagcaccggtcacggactgggaaggcagccttcccttggtgtttaatcattgcagggacgcctgattattcacccacgtttcaaaggtgtcagaccatgcagggatgcctgccttggtccttcacccttagcggcaggtcccgcttttctgggaaaggggcaagtaccccaaccccttctctccttgtctctaccccttctctgcttttctgggggaggggcaagtacccctcaaccccttctccttcacccttagcggcaagtcccgcttttctgggggaggggcaagtacccttcaaccccttctccttcactcttagtggcaagtcccacttttctagaggaggggcaagtaccccaacctcgtatctctgcaccccaatcccttatttctgtgccccgaccccttatttctgtgcccctaccccttatttccacgcctcatcccttatttccatgccccatcccttatttctgtgccccatcccttatttccgtgccccaaccccttatctctgtgccccaacccctttttccacttttctggaaggtaagaacccccaaacctcttccctctgtttctctactctcttctctaggcttgcttccttcactataggcaaccttccaccctccattcctccttctactcccttggcctgtgttctcaaaaacttaaaacctcttcaactcacacctgacataaaacctaaatgccttattttcttctgcaatgccgcctgaccccaatacaaactcaacagcagttccaaatagccagaaaatggcactttgactttttccatcctacaagatctaaataattcttgtcataaaataggcaaatggtctgaggtgcctgacatccaggcattcttttacacatcagtcccttcccagtctctgtgcccagtgcaactcgtcccaaatcttccctctttccctcccgcctgtcccctcagtcccaacaccaagcgtcgctgagtctttctaatcttccttttctacagacccatctgacctctcccttcctccccaggctgctcctcgccaggccgagctaggtcccaattcttcctcagcctctgctcctccaccctataatctttttatcacctcctctcctcacacctggtccagcttacagtttcgttccgtgagtagccttccccctcctgcccggcaatttactcttaaaaaggtggctggagctaaaggcatagtcaaggttaatgctcctttttctttatcccaaatcagatagcgtttaggctctttttcatcaaatataataatccagctcagttcatgacttgtttggcagcaaccctgagacactttacagccctagaccctaaaagctcaaaaggccgtcttattctcaaaataatgtcaatctgctcctgacattaaataaaactccaaaaattaaattccggccctcaaaccccacaacaggatttaattaacctcaccttcaaggtgtacaataatagaaaaaagttgcaattccttgcctccactgtgagacaaaccccagccacatctccagcacacaagaacttccaaatgcctgaaactcagcggccaggcgttcctccagaacctcctcccccaggagcttgccacaagtgccagaaatctgaccaccaggccaaggaatgcctgcagcccaggattcctcctaagccgtgtcccatctgtgtgggaccccactgaaaatcggactgttcaactcacctggcagccactcccagaggccctggaactctggcccaaggctctctgactgactccttcccagatcttctcggcttcgcagctgaagactgacactgcccgatggcctcggaagccccctagaccatcacagacgcagagcttcgggtaactctcacagtggaaggcaagcctgtccccttcttaatcaatacggaggctacccactccacattaccttcttttcaagggcctgtttcccttgcctccataactgttgtgggtattgacggccaggcctctaaacctcttaaaactccccaactctggtgccaacttagaaaatactcttttaagcactcctttttagttatccccacctgcccagttcccttattaggctgagacactttaactaaattatctgcttccctgactatccctggactacagctatatctcattgccacccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaacgccaatatcccatccggcagcacgctttaaaaagattaaagcctgttatcactcgcctgctatagcatggccttttaaagcctataaactctccttacaattcccccattttacctgtcctaaaaccagacaagccttacaagttagttcaggatctgtgccttatcaaccaaattgttttgcctatccaccctgtgatgccaaacccatatactctcctatcctcaatacctgtctctacaacccattattctgtcctagatctcaaacatgctttctttactattcctttgcacccttaatcccagcctctcttcactttcacttggactgaccctgacacccatcaagctcagcaaattacctaggctgtactgctgcaaagcttcacagacagcccccattacttcaatcaagcccaaatttcttcctcatctgttacctatctcggcataattctcataaaaacacacgtgctctccctgccaatcgtgtccgactgatctctcaaacccaagcaccttctacaaaacaacaactcctttccttcctaggcatggctagcatggtcagaattcttacacaagagccaggaccacaccctgtagcctttctgtccaaacaacttgaccttactgttttagcctagccctcatgtctgcgtgcagcggctgccgctgctttaatacttttagaggccctcaaaatcacaagctatgctcaactcactctctacagttctcataacttccaaaatctattttcttccccatacctgacgcatatactttctgctccccggctccttcagctgtactcactctttgttgagtctcccacaattaccgttgttcccggcccagacttcaatccggcctcccacattattcctgataccacacctgacccccatgactatctctctgatccacctgacattcaccccatttccccaaatttccttctttcctgttcctcaccctgatcacgcttgatttattgacggcagttccaccaggcctaatcgccacacaccagcaaaggcaggttatactatagtacaagccactagcccgcctcttagaacctctcatttcctttccatcgtggaaatctatcctcgaggaaataacttctcagtgttccatctgctattctactactcctcagggattattcaggccccctcccttccctacacatcaagctccaggatttgccccacccaggactggcaaattagctttactcaacatggcctgagtcagataactaaaatacctcttagtctaggtagattctttcactggataggtagaggcctttcctacagggtctgagaaggccactgaggtcatttcttccgttctgtcagacataattcctcagtttagccttcccacctctatacagtctgataacagacgagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactagacaatacttttaccactttcccttctcagaattcaggcctgtcctcggaatgctacagggtacagcccatttaagctcctgtatagatgctcctttttattaggccccggtctcattccagacaccagaccaacttagactgtgccccaaaaatcttgtcatccctactatcttctgtctagtcatactcctattcaccgttctcaactactcataccctgctcttgtttacactgccagtttacactgtttttccaagccatcacagctgatatctcctggtgctatccccaaactgccactgttaactcttgaagtaaataaataatctttgctggcaggactatgctgtatctccttaggcactctctaatcagatatcctgagtcgtcccaattcttagaccttttatacctgtttttctccttctgttattccatttagtttctcaattcatccaaaaccgtatctaggccatcaccaatcattctatacaacaaatgtttcttctaacatccccacaatatcaccccttaccacaagacctcccttcagcttaatctctcccactctaggttcccacgctgcccctaatcctgcttgaagtagccctgagaaacatcacccattctctctccaaaccaccccccaaaaatttttgccgccccaacacttcaatactattttgttttatttttcttattaatagaagaaggcaggaatgtcaggcctctgagcccaagcccagccatcacatcccctgtgacttgcacatatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcacattgcgagccccactcctgcccgccagagaacaacccccctttgactgtaattttcccttacctacccaaatcctataaatggccccacccctatctccctttgctgactctcttttcggactcagcccacctgcacccaggtgattaaaagctttattgctcacacaaagcctgtttggtggtctcttcacagggacgcacatgaaa

SEQ ID NO: 190 - DNA, 362 bp, Homo sapiens
tgggtagctaggcagacatgagcagggcgggaaaggccccctaccccaggaatgtcaggcaaccatcaggtgatggtcaggtggttgttcgactgtctctctaaaataataattggtcacagctgggaggtgccagggaaaggcagcctcccagtagatgggaaacacctgaaactggtaccagccgcttcctgataagatctcaggagttgggtgagtgggccccagcctgttcactaagaggcaaaatggtggagtttaactggcacatgaccttcctctaggaacattcaactggtaagggaaaaatgcctcaaatgagcacgtacacaatcttcagtaaacacattgtgcatatggcc

SEQ ID NO: 191 - DNA, 3863 bp, Homo sapiens
ttgctaacttgcgtgctagaaggactaaggaaaactaggaagaagcctatgaattattcagtgatgtccactataacacagggaaaggaagaaaatcctactgcctttctagagagactaagggaggcattgagaaagcatacctccctgtcacctgactctactgaaggccaactaatcttaaaggataagtttatcacccagtcagctacagacattagaaaaaaacttcaaaagtccaccttaggcccggagcaaaacttagaaaccctattgaacttagcaaccttggttttctataatagagatcaggaggagcggtggaacaggacaaacggtataaaaaaaaaggccaccgctttagtcatggccctcaggcaagtggactttggaggctctggaaaagggaaaagctgggcaaatcgaatgcctaatagggcttgcttccagtgcggtctaccaggacactttaaaaaagattgtccaaatagaagtaagccgcccccttgtccatgccccttatgttgagggaatcactggaaggcccactgccccaggggatgaaggtcctctgagtcagaaaccactaaccagatgatccagcagcaggactgagggtgcctggggcaagtgccagcccatgccatcaccctcacagagccccaggtatgcttcaccattgagggccaggaggttaactgtctcctggacactggcacagccttctcggtcttactctcctgtcccggacaactgtcctccagatctgtcactatccgaggggtcctaggacagccagtcactagatacttctcccagccactaagttttgactgaggagctttactcttttcacacgcttttctaattatgcctgaaagccccactcccttggttagggagagacattctagcaaaagcaggggccattatacacctgaacataggagaaggaacacccatttgttatcccctgcttgaggaaggaattaatcctgaagtcttgccaacagaaggacaatatggatgagcaaagaatgctcgtcctgttcaagttaaactaaaggattctgcctcctttccctaccaaaggcagtacccccttagacccaaggctcaacaaggactccaaaagattgttaaggacctaaaagcccaaggcctagtgaaatcatgcaatagcccctgcaatactccaattttaggagtacagaaacccagcagacagtggaggttagtgcaagaactcaggattatcaatgaggccgttgtccctctagacccagctgtacctaaccctcatactctgctttcccaaataccagaggaagcagtgtggtttacagtcctggaccttaaggatgcctttttcagcatccctgtacatcctgactctcaattcttgtttgcctttgaagatccttcaaacccaacgtctcaactcacctggactgttttaccccaagggttcagggatagcccccatctatttggccaggcattagcccaagacttgagccaattctcatacctggacactcttgtccttcggtacatggatgatttacttttagctgccagttcagaaaccttgtgccatcaagccacccaagcgctcttaaatttccttgctacctgtggctacaaggtttccaaaccaaacgctcagcactgctcacagcaggttaaatacttagggctaaaattatccaaaggtaccaaggcccttggtgaggaacgtatccagcctatactggcttaccctcatcccaaaaccctaaagcaactaagagggttccttggcataacaggtttctgccaaatatggatattcccaggtacagcaaaatagccagaccattatatacactaattaaggaaactcagaaagccaatacccatttagtaagatggacacctgaagcagaagcagctttccaggccctaaagaaggccctaacccaagccccagtgttaagcttgccaacagagcaagacttttctttatatgtcatagaaaaaacaggaatagctctaggagtccttacacagatccaagggacaagcttgcaacccatggcatacctgagtaaggaaattgatgtagtggcaaagggttggcctcattgtttacgggtagtagcggcagtagcagtcttagtatctgaagcagttaaaataatacagggaagagattttattgtgtggacatcttatgatgtgaatggcatactgactgctaaaggagacttgtggctgtcagacaaccgtttacttaaatatcaggctctattacttgaagggccagtgctgtgactgcatacttgtgcaactcttaatccagcaacatttcttccagacaataaagaaaagatagaacataactgtcaacaagtaattgctcaaacctacgctgctcgaggggaccttttagaggttcccttgactgatcccaacctcagcttgtatactgatggaagttcctttgtagaaaagggactttgaaaagcgaggtatgcagtggtcagtgataatggaatacttaaaagtaatcccctcactccaggaactagtgctcagttggcagaactaatagccctcacttgggcactaaaattaggagaaggaaaaaaggtaaatatatatacagactctaagtatgcttacctagtcctccatgcccatgcagcaatatggagagaaagggaattcctaacttccaagggaacacctattaaacatcaggaagtctttaggagattattattggctgtacagaaacctaaagaggtggcagtcttacactgccggggtcatcagaaaggaaaggaaaggaaaatagaaggaaaccaccaagtggacattgaagccaaaagagccacaaggcaggaccctccatttgaaatgcttatagaaggacccctagtatggggtaatcccctccgagaaaccaagccccactactcagcaggaaaaatagaatagggaacctcatgaggacatactttcctcctctccagatggctagccaccgaagaaggaaaaatacttttgcctgcagctaaccaatagaaattacttaaaaaccttcaccaaacctttcagttaggcattgatagcacccatcagatggccaaattattatttactggaccaggccttttcaaaactatcaagcagatagtcagggcctgtgaagtatgccaaagaaataatcccctgcactgcaggccatacatttcaatccctgtatctttaatctccttgttaagtttgtctcttccagaatcaaagctgtaaaactaccaatcgttcttcaaatggagccccagatacagtccatgactaaaatctgccacagacccctggactggcctgctagccaatgctctgatgttaatgacatcaaaggcactcctcccgaggaaatctcaactgcacaacccctactatgccccaattcagcaggaagcagttagaacggtcgtcagccatcctctccaacagcacttgggttttcctgttgagagcggggactgagagacaggactagctgggtttcctaggccgattaagaatccctaagcctagctgggaaggtgaccacgtccacctttaaacatggggcttgcaacttagctcacacccgaccagtcagatagtaaagagagctcactaaaacgctaattaggctaaaacaggaggcaaagaaatagccaatcatctatcacctgagaccacagggggagggacaatgatcgggatataaacccaggcattcgagctggcaacagctaccctctttgggtcccctccctctgtatgggagctctgtcttccctctattaaatcttgcaactgca

SEQ ID NO: 192 - DNA, 968 bp, Homo sapiens
gtggggaaaagaaagggagaccagattgttactgtgtctgtgtagaaagaagtagacataggaggctccattttgttctgtactaagaaaaattcttctgcattgagatgctgttaatctgtaacactacccccaaccctgtgctccctgaaacacgtgctgtgtcaactcagggttaaatggattaagggctgtgcagggtgtgctttgttaaacaaatgcttgaaggtagcatgcttgttaagagtcatcaccactccctaatctcaaaccacttcctaatctcaagtacccagagacacaaaccactgaggaaggccgcagggatctctgcctaggaaagccaggtattgtccaaggtttctccccatgtgatagcctgagatatggcctcgtgggaagggaaagacctgaccgtcccccagcccgacacccgtaaagggtctgtgctgaggaggattagtaaaagaggaagtaacacctccttgcggttgagacaagaggaaggcatctgtctcctgctcgtccctgggcaatggaatgtctcggtgtaaaacctgattgtatattccatctactgagataggggaaagccaccttagggctggaggtgggacatgcgggcagcaatactgctctttaaggcattgagatgtttatgtgtatacatatccaaagcacagcacttaattctttaccttgtttatgatgcagagacctttgttcacgtgtttacctgctgaccttctctccactattatcctatgatcctgccacatccccctctccgggaaacgcccaataatgatcaataaatactaagggaactcagaggctggcgtggatcctccgtatactgaacgctggtcagctgggcccagttttctttctctatactttgtctctgtgtctcttgttccacctaacgagaaacgcccacaggtgtggaggggcaacccaccccttca

SEQ ID NO: 193 - DNA, 5809 bp, Homo sapiens
gtcaggcctctgagcccaagccaagccatcgtatcccctgtgacctgcacctgtacgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctccaaaagcacccccactgagcaccttgcgacccccactcctgcccactgagcaccttgcaacccccactcctacccgccagagaacaaacccccttggactgtaattttcctttacctacccaaatcctataaaacggcctcacccttatctcccttcactgacccttttcggactcagcctgcctgcacccaggtgaagtgagcaacagccatgttgctcacacaaagcctgtttggtggtctcttcacatggacgcgcatgaaatttggtgccgtgactcggatcgggggacctcccttgggagatcaatcccctgtcctcctgctctttgctccgtgagaaagatccacctacgacctcaggtcttcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaagagacatgttttatccgtgaacccaaaactccggcgccagtcacggactgggaaggcagccttcccttggtatttaatcattgcagggacgcctctctgattatacactcacgtttcaagggtgtcagaccacgcagggacgcctgccttggtccttcacccttagcggcaagtcccgctttcctggggcaggggcaagtacccctcaaccccttctccttcacccttagcggcaagtcccgctttcctagggggcaagaaccccccaatcacttatttccacaccccaacctcttatctctgtgccccaatcgcgtatttccacaccccaacctcttatctctgcaccccaatcccttatttccgcaccctgacctcttatctctgtgccccaatcccttatttccgtgtcccagccctttctctgcttttctggaggggaagaaacccccaccccttctccgtgcctctactcttttctctgggcttgcctccttcactatgggcaagcttccaccttccattcctctttcttctcccttagcctgtattcttaagaacttaaaacctcttcaattctcacctgacctaaaatctaagagtcttattttcttctgcaatgccgcttgaccccaatacaaactcaagagtagttccaaatagccagaaaacggcactttcaatttttccaccctacaagatctaaataattcttgtcgtaaaatgggcaaatggtctgaggtgcctgaagtccaggcattcttttacacatcagttccttcctagcctctgtgcccagtgcaactcgtcccaaatcttccttctttccctccctcctgtcccctcagtaccgaccccaagcgtcgctgagtctttctaatcttccttttctacagacccatctgacctctcccctcctcgacaggccaagctaggccccaattcttcctcagcctccgctcctccaccctgtaatctttttattgcctcccctcctcacacctggtctggcttacagtttccttctgtgactagccctccccgacctgcccagcaatttactcttaaaaaggtggctggagccaaaggcatagtcaaggttaatgctcctttttctttatcccaaatcagatagcgtttaggctctttttcatcaaatataaaaatccagcccagttcatggctcgtttggcagcaaccctgagacactttacagccctagcccctaaaaggtcaaaaggccgtcttattctcaatatacattttattacccaatctgctcccgacattaaataaaactccaaaaactagaatctggccctcaaaccccacaacaggacttaattaacctcaccttcaaggtgtgcaataacagaaaaaagttgcaattccttgcctccactgtgagacaaacctcagccacatctccagcacacaagaacttccaaacgcctgaactgtagcagccaggcgttcctccagaacctcctcccccaggaacttgctacacatgccggaaatctggccactgggccaaggaacacccgcagcccaggattcctcctaagccacgtcccatctgtgtgggaccccactgaaaattggactgttcaactcacctggcagccactcccagagctcctggaactctggcccaaggctctctgactgactccttcttggcttaccggctgaagactgacactgcccgattgcctcggaagccccctagaccatcacggacgccgagcttcgggtaactctcacagtggaaggtaagcccgtccccttcttaatcaatacggaggctactcactccacattacgttcttttcaagggtctgtttcccttgcctccataactgttgtgggtattgatggccaggcttctaaacctcttaaaactccccatctggtgccaacttagacaatactcttttaagcactcctttttagttgtccccacctgcccagttcccttattaggctgagacactttaactaaattatctgcttccctgactattcctggactacagctatatctcattgctgctcttcttcccaatccaaagcctcctttgggtcctcctcttgtatcccccaaccttaacccacaagtataagatacctctactccctccttggcgaccaatcatgcaccccttaccatctcattaaaacctaatcacccttaccccactcaacgccaatatcccatcccacagcacactttaaaaagattaaagcctgttatcactcgcctgctacagcatggccttttaaagcctataaactctccttacaattcccccattttacctgtcctaaaaccagacaagccttacaagtttgttcaggatctgcgcctcatcaaccaaattgttttgcctatccaccccgtggtgccaaacccatatactctcctatcctcaatacctgcctctacaacccattattctgttctagatctcaaacatgctttctttgctattcctttgcacccttaatcccagcctctcttcgctttcacttggactgaccctgacacccatcaagctcatcaaattacctaggctgtactgccgcaaagcttcacagacagcccccattacttcaatcaagcccaaatttcttcctcatctgttacctatcttggcataattctcataaaaacacacgtgctctccctgccaatcgtgtccgactgatctctcaaacccaagcaccttctacaaaacaacaactcctttccttcctaggcatggttagcgaggtcagaattcttacacaagagccaggaccacaccctgtagcctttctgtccaaacaacttgaccttactgttttagcctagccctcatgtctgcatgcagctgctgccgctgcattaatacttttagaggccctcaaaatcacaaactatgctcaactcactctctacagttctcataacttccaaaatctattttcttcctcatacctgatgcatatactttctgcttcccggctccttcagctataccccactctttgttgagtctcccacaattaccgttgttcctggcccagacttcaatcctacctcccacattattcctgataccacacctgacccccatgactgtatctctctgatccacctgacattaaccccatttccccaaatttctttctttcctgttcctcaccctgatcacgcttgatttattgatggcagttccaccaggcctaatcgccacacaccagcaaaggcagatgatgctatagtacaagccactagcccgcctcttagaacctctcatttcctttccatcatggaaatctatcctcaaagaaataacttctcagtgttccatctgctattctgctcagtgttccatctgctattctactactcctcagggattattcaggccccctcccttccctacacatcaagctcgaggatttgccccacccaggactggcaaattagctttactcaacatgcccttagtcagataactaaaatacctcttagtctaggtagataatttcactggataggtagaggcctttcctacagggtgtgtacagggtgtgagaaggccaccgcagtcatttattcccttctgtcagacataattcctcagtttagccttcccacctcaatacagtctgataacagacgagcctttatcagtcaaatcagccaagcagtttttcaggctcttagtattcagtgaaacctttatatcccttacggtcctctgtcttcaagcaaagtagaatggactaaaggtcttttaaaaacacacctcaccaagctcagccaccaacttaaaaaggactggacaatacttttaccactttcccttctcagaattcaggcctgtcttcagaatgctacagggtacagcccatttaagctcctgtatagacgctcctttttattaggctccagtctcattccagacaccagaccaacttagactgtgccccaaaaaacctgtcatccctactatcttctgtctagtcatactcctattcaccgttctcaactactcatacatgccctgctcttgtttacactgctggtttacactgtttttccaagccatcacaactgatatctcctggtgctatccccaaactgccactcttaactcttgaagtaaatacataatctttgctggcaggactatgctgaatctccttaggcactctctaatcagatatcctgagtcgtcccaattcttagaccttttatacctgtttttctccttctgttattccatttagtttctcaattcatccaaaaccgtatccaggccatcaccaatcattctatacgacaaatgtttcttctaacatccccacaatatcaccccttaccacaagacctcccttcagcttaacctctcccactctaggttcccacgccgcccctaatcccgcttgaagcagccctgagaaacatcgaccattctctctccataccacccccaaaaaattttcaccgccccaacacttcaacactattttgttttatttttcttattaagaaggcaggaatgtcaggcctctgggcccaagccaagccatcacatcccctgtgacctgcacctataagcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctccaaaagcatccccactgagcaccttgcgacccccactcctgcccactgagcaccttgcaacccccactcctacccgccagagaacaaacccccttggactgtaattttcctttacctacccaaatcctataaaacggccccacccttatctcccttcgctgactctcttttcgaactcagcccgcctgcaaccaggtgaaataaacagccatgttgctcacacaaagcctgtttggtggtctcttcacacggacgcacatgaaa

SEQ ID NO: 194 - DNA, 954 bp, Homo sapiens
gtggggaaaagagagatcagattgttactgtctctgtgtagaaagaagtagacagaggagactccattttgttctgtactaagaaaaattcttctgccttgagatgctgttaatctgtaaccttatccccaaccctgtgctccctgaaacatgtgctgtgtcaactcagggttaaatggattaagggctgtgcaagatatgctttgttaaaacaaatgcttgaaggcagcatgctcgttttaagagtcatcaccactccctaatctcaagtatccggggacacaaacactgcggaaggccacagggacctctgcctaggaaacccaggtattgtccaaggtttctccccatgtgatagtctgaaatatggcctcgtgggaagggaaagacctgaccggggtcccccagcctgacaccctgtgctaaggaggattagtaaaagaggaaggaacgcctctttgcagttgagacaagaggaaggcatctgtctccagccagtccctgggcaatggaatgtctcagtgtaaaacccaattgtatgttccatctactgagacaggggaaaaccgcctcaggggtggaggtgggacatgcgggcagcaatactgctctttaaggcattgagatgtttatgtgtatgcacatctaaagcacagcacttaattctttaccttgttcatgatgcagagacctttgttcacgtgtttatctgctgaccttctctccactattatcctatgaccctgccacatccccctctccgagaaacacccaagaatgatcaataaatactaagggaactcagaggccggcgggatcctctgtatgctgaacactggtcccctgggcccccttatttctttctctatactttgtctacgtgtctttttccaagtctctcattccacctaacgagaaacacccacaggtgtgaaggggcaacccaccccttca

SEQ ID NO: 195 - DNA, 4487 bp, Homo sapiens
gtcaggcctctgagcccaagctaagccatcatatccccagtgacctgcacatatacatccagatggcctgaagcaactgaagatccacaaaaaaagtgaaaatagccttaactgatgacattccaccattgtgatttatttctgccccaacctaactgatcaatgtactttataatctcccccacccttaagaagtttctttgtaattccccccacccttgagaatgtactttgtgagatccgcgccctgtccccaaaatattgctcttaactccactgcctatcccagaacccataagaactaatgataatcccaccatcctttgctgactccttttttggactcagtctgcctgcacccaggtgaaataaacagccttgctgctcacacaaagcccgtttggtcctctcttcacatggacacgtgaaacatttggtgccgaagatccgggtcagtgggactccttcaggagaccagtcccctgtcttcaccctcactccgtgaagagatccacctatgacctcaagtcctcagaccaaccagcccaaggaacatctcgccgattttaaatcgggtaagtggcctctttttactctcttctccaacctctctcactatccctcaacctctttctcctttcaatcttggtgccatgcttcaatctctcccttctcttaatttcaattcctttcattttctggtagagacaaaggagacacattttatctgtggaaccaaaactccggcgctggtcacggactcgggaaggcagccttcccctggtgtttaatcattgcggggacgcctctctgattattcacccacattccattggtgtctgatctccgcagggacacctgccttggtcattcacccacattcccttggtggcaagtcaattgcggggacgcctgctttggctgctcacccacgttgcagcccagggctgctccccacccgccttctctgtgtctctacccttctctttacacttgcctccttcactatgggcaaacttccaccctccattcctccttcttctcccttagcctgtgttctcaagaacttaaaacctcttcaactcttgcctgacctaaaatctaagtgtcttattttcttctgcaataccgcttgaccccaatacaaactcaataatggttctaaatagccagaaatcggcacttttgatttctccattttacaagatctagataattttcgtcaaaaatgggcaaaaggtgtgaggtgcctgacgtccaggcattcttttacacatcggtccctccctagtctctgctcccaatgagacttgtcccaaatctttcttctttctctcctgtctgttccttcagtctccaccccaagatatgagtcctttgaatccttcttttctatggactcatctgacctctccccttctccccaggctgctccttgccaggccaagccaggtcccaattcttcctcagcctctgctccccaaccctaaaatccttcaatcacctcccctcctcacaccggtctggcttccaattttgttcccacgactagccctccccacctgcccaacaatttcctcttagagaggtggctggagctgaaggcatagtcagggtacatgtgcctttttctcgatcagacctttcccaaatcagccagcgtttaggctctttctcatcagaccccactaaatatatactggaattccgatatctaaatctgtcttacagtttaacctggaatgacttaaatgtcatcctaacttctaccctctccccaaatgaacgggaaagagttttttctctagcccaatttcacactgataactgccagcttcatgagccagacctccatgaaggcattagagcagttccccgagaagatcccaatggaactatcaggcaaattccccaggtatagctaggcgagattacatggtttcctgcctagttgaagggcttaaaaaggcagcttacaaagctgttaattaagacaaacttaaaggaactactcaaggtaaagacgaaaacccagcccagttcatggcctgcttaggagcaacccttagactctttacagccccagatcctgaaaggtcagaaggctgtcttattctcaatatgcattttattttattacccaatctgttcccaacattaaataaagctccaaaaattaaattccagccctcaaaccccacaacaggacttaattaggtgtacaataatagagtagaggcagccaagtagcaatgtatttctgagttgcaattccttgcctccgctgtgagacaaaccccagccacatctccagcacacaagaactccaaacacctgaaccgcagctgccaggggttcctctagaacctcctccctcaggagcttgctacaagtgccagaaatctggccactgggccaaggaatgcccgcagcctgggattcctcctaagctgtgtcccatctatgtgagtccccactggaaactggactgtccaactggcccgaggctctgactgactccttcccatatcttctcggcttagcagctgaagactgacactgcccgatcgcctcagaagcctcctggaccatcgcggatgctttgggtaactcttacagtggagggtaagtccgtccccttcttaagcaatacggaggctacccactccacattaccttcttttcaagggtgtatttcccttgcctccataactgttgtgggtattgacggccaggcttctaaacctcttaaaactccccaactctggtgccaacatggacattcttttatgcactcttttttagttatccccacctgcctagagctcccttattaggtcgagacattttaactaaattatctactttcctgactattcctgggctacagccacacctcattgctgctttttccccagttcaaagcctccttcgcatcctcctctcatatacccccaccttaatccacaagtataggacacctctaccccctccttggcgactgatcatgcacctcttaccatcccattaaaacctaatcacccttaccctgctcaatgccaatatcccatcccacagcatgctttaaaaggattaaagcctgttatcactcgcctgttacagcttgggcttttaaagcctgtaaactctccttacaattcccctgttttacctgtccaaaaactggacaagccttacaggttagttcaggatctggccttaccaaccaaattgtctggcctatccaccccgtgatgccaaagccatatactctcctatcctcaatacctccctccacaacccctccataacccattattctgttctggatctcaaacatgctttctttactattcctttgcacccttcatcccagcctctcttcgctttcacttggactgaccctgacacccatcaggctcaacaaattacctaggctgtactgctgcaaggcttcacggacagcccccatgacttcagttaagcccaaatttcttcctcatctgttacctatctcagcataattgttcacgaaaacacacatgctctgcctgctgatcatgtccagctaattccccaaaccccaatcccttctacaaaacaactcctctccttcctacgcatggttaggtacttccgcctttggatacctagctttaccatcctgactaaaccattatgtaaactcacaaaaccaaacccagctgaccccatagatcctaaatccctttgccactcctttccgttccttaaaaacagccctagaagctgcccccacactagctctccctaactcattccaaacctttttcattacacacagccaaagtgcagggctgtgcaatcggagttcttacacaaaagccaggaccgcaccctgtagcctttctgtccaaacaacttgaccttactgttttagcctagccctcatgtctgcatgcggtggctgctgctgccctaatacttccagaggccctcaaaatcacaaactttgctcaactcactctatacagttctcataacttccaaaatctattttcttcctcacacctgacacatacactttctgctccctggctccttcagctgtactcactctttgttgagtctcccacaattaccattgttcctggcctggacttcaatccggcctcccacattattcctgataccacacctggcccccatgactgtatctctctgatacacttggcattcacttcatttccccatgtttccttctttcctgttcctcaccctgatcacacttggtttattgatggcagttccaccaggcctaatcgccaaacaccagcaaaggcaggctatgctatagtatcttccacatctatcattgaggctaccgctgtgccccatctccactacctctcagcaagccgaactcattaccttaacttgggccctcactcttgcaaagggactatgcgttggtatttatactgaccccatatcctgcaccaccatgc

SEQ ID NO: 196 - DNA, 443 bp, Homo sapiens
agaccaccacttctcctgctgccctcctctctcccacttttgcctagtttataagacaggcgaaaagggagaaagcaaaaagttggaaagaaacagaagtaagataaatagccagacgaccctggcaccaccacctggccctggtggttaaaaaaataataataatattaacccctgacctaaactacttgtgttatctgtaaattccagacatcgtatgaggaagccctgcgaaactttctgtcctgtcagctgatgcatgtagcccccagtcacgctccccacgcttgctcgatctatcacgaccctttcacgtggaccccttagagttgtaagcccttaaaagggccaaggatttctttttcagggagcttggctcttaagatgcaagtctgccaaagctcccgcccgaataaagcctcttccttctttaatgaggagtt

SEQ ID NO: 197 - DNA, 5995 bp, Homo sapiens
ataataatattgttaaaatggtctgttcctaacttaactgatgatattatcttgtggaattccttctcctggctcatcctggctcaaaaactcccctactgagcaccttgtgaccctcattcctgcccgccagagaacaaccccccttttttcctttacctacccaaatcctataaaacggcccacccctatctcccttcgctggctctcttttcggactcagcccacctgcacccaggtgaaataaacagccttgttgctcacacaaagcctgtttggtggtctcttcacacagacacacatgaaatttggtgccatgactcggatcgggggacctcccttgggatatcaatcccctgtccccccttgagaaagatccacctatgaccttgggtcctcagaccgaccagcccaaggaacatctcaccaatttcaaatacagtaagcggcctgtttttactttcttctccaacctctctcacgatccctcaacctctttctcctttcaatcttggtgccacacttcaatctcccttctcttaatttcaattcctttcattttctggtagagacaaaggagacacattttatccgtggacccaaaactccagcaccggtcacggactcaggaaggcagccttcccttggtgtttaatcattgcaaggacagctctctgattattcacccacgttccactggtgtctgatctctgcggggacacctgccttgatcattcacccacattcccttggtggcgagtcaattgcggggacacctgccttgatcattcacccacattcccttggtggcaagtcaattgcggggacgcctgccttgatcattcacccacattcccttggtggcgagtcaattgcggggacgcctgctttggctgctcgcccacattgcagcccagggctgttccccacccccttctccgtgtctctacccttctctttaaacttgcctccttcactataggcaaccttccaccctccattcctccttcttctcccttagcctgtgttcttaagaacttaaaacctcttcaactctcgcctgacctaaaatctaagcatcttattttcttctgcaacaccgcttggccccaatagaaacttgacaatggctccaaatagccagaaaacagcacttttgatttttccatcctacaagatcgagatgattcttgtcataaaatgggcaaatggtctgaggtgcctgacgtccaggcattcttttacacactgttccctcccttctctctgttcccaatgcgactcgtcccaaatcctccttctttccctcccgcctgtcctctcagtcccaaccccaagcatcgctgagtctttctaatcttccttttctacagacccatctgacctctcccctcttccccaggctgctcctcgccaggccgagccaggtctcaattcttcctcggcctctgctcccacaccctataatccttttatcacctcccctcctcacacccggtctggcttacagtttcattctgtgactagcccgccccaaccttcccagcaatttcctcttaaaaaggtggctggagctaaaggcacagtcaaggttaatgctcctttttctttatccgacctctctcaaatcagttagcattcaggctttttcatcaaatatgaaaaatccagcccagttcatggctcgttcggcagcaaccctgagacgctttacagccctagaccctaaaaggtcaaaaggccgtcttattctcaatatacattttattacccaatccgctcctgacattaaataaaactccaaaaattaaattccagccctcaaaccccacaacaggacttaattaacctcgcctttaaggtgtacaataataaagtagaggcagccaagtagcaacatatttctgagttgcaattccttgcctccactgtgagacaaaccccagccacatctccagcacacaagaacttccaaacacctaaaccgcagtggccagagtttccttcagaacctcctcccccaggagcttgctacaagtgccggaaatctggccactaggccaaggaatgcccacagcccgggattcctcctaagccgtgtcccatctgtgcaggacccaactgaaaatcggactgttcaactcacctggcagccactctcagggcccctagaactctggcccaaggctctctgactccttcccagatcttctcagcttagcagctgaagactgacactgccagatcgcctcaaaagcctacaggaccatcacagacgctctgggtaactctcacagtggagggtaagtctgtccccttcttaatcaatacagaggcaacccactccacattaccttcttttcaaaggcttgtttcccttgcctccgtaactattgcaggtactgacggccaggcttctaaacctcttaaaactcctcaactctggtgccaacttagacaatactcttttaagcactcctttttagttatccccacctgccctgttcccttattaggccgagacactttaactaaatttaaattatctgcttccctgactattcctgggctacagccacacctcattgctgccttttcccccagttcaaagcctccttcacatcctccccttgtatctccccaccttagcccacaagtataggacacctctactccctccttggcgaccgatcatgcaccccttaccatcccattaaaacctaatcacccttatcccgctcaatgccaatatcccatcccttagcacgctttaaaaggattaaagtcttatcaatcgcctgctacagcatggccttttaaagcctataaactccccttacaattcccccattttacctgtcctaaaaccaggcaaggcttacaggttagttcaggatctgcgtcttatcaaccaaattgttttgcctatccaccccgtggtgccaaacccatatactctcctatgctcaatacctccctccacaacccattattctgttctggatctcaaacatgctttctttactattcctttgcacccttcatcccagcctctcttcactttcacttggactgaccctgacacccatcaggctcagcaaatcacctgtgctgtactgccgcaaagcttcacagatagcccccattacttcagtcaagcccaaatttcttcctcatctgttacctatctcggcataattctcataaaaacacacgtgctctccctgccgatcgtgtccgactgatctcttaaaccccagcaccttctacaaaacaactcctttccttcctaggcatggttggatacttttgactttagatacctggttttgccatcctaacaaaaccattatgtaaactcacaaaaggaaacctagctgaccccatagatcctaaatcctttccccactcctttctgttccctgaagacaactttagagactgcccctaccctagatctccctgaatgatcccaacccttttcattacccacagctggagtgcagggctgtgcagtcagaattcttacacaagaaccgggaccgcgccctgtagcctttttatccaaacaatttgaccttactgttttgcctagccctcaagtctgcgtgctgcggccgccaccgccctaatacttttagaggcccttaaaatcacaaactatgctcaactcactctctacagttctcataacttccaaaatctattttcttcctcccacctgacacatatactttctgctccccggctccttcagctgtactcactctttgttgagtctcccacaattaccattgttcctggcccagatttaatccggcctcccacattattcctgataccacacctgacccccatgactgtatctctctgatccacctgacattcaccccatttccccatatttccttctttcctgttcctcaccctgatcacacttggtttattgatggcagttccatcaggcctaatcgccacacaccagcaaaggcaggctgtgctatagtacaagccactagcctgcctcttagaacctctcatttcctttccatcgtggaaatctatcctcaaggaaatcacttctcagtgttccgtctgctattctacaacttctcagggattattcaggccccctcccttccctacacatcaagcttagagatttgcccccacccaggactggcaaattgactttgctcaacatgccctgagtcaggaaactaaaatacctcttggtctaggtagacactttcactggataggtagaggcctttcccacagggtctaagaagaccaccacggtcatttcttcccttctgtcagatataattccttggtttggccttcccacctctatacagtccgatagcagactggcctttattagtcaaatcagccaagcattttttttcaggctcttggtattcagtgaaacctttataatccttacagtcctcagtcttcaggaaaggtagaatggactaatggtcttttaaaaacacacctcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaacacacctcaccaagctcagccaccaacttaaaaaggactggacaatacttttaccactttcccctctcagaattcaggcctgtcctcagaatgctacaaggtacagcccatttaagttcctgtatagacgctcctttttattaggccccagtctcattccagacaccagaccaacttggactgtgccccaaaaaacttgtcatccctactatctcctgtctagtcatactcctattcaccgttctcaactactcatacatgccctgctcttgtttacactgtttctccaagccatcacagctgatatctcctggtgctatccccaaactgccagtcttaactcttaaagtaaataaataatctttgctggcaggactatgctgaatctccttaggcactctctaattagatgtcttaggtcctcccaattcttagacctttaatacttgtctttctccttctcttattccatttagcttttcaattcatacaaaaccatatccagaccatcaccaataattctaaatgacaaatgtttcttctaacaaccccacaatatcatcccttaccacaaaatcttccttcagcttaatctctcccgctttaggttcctacacctcccctaatcccgctcaaagcagccctgagaaacatcgcccattgtctctccataacacccccaaaaattttcaccgtcccaacattctaccactatttcattttatttttcttattaatatatgaagacaggaatgtcaggcctctgagcccaagctaagccatcatatcccatgacctgcacgtacacatccagatggccggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcccgccagagaacaaccccccttttttcctttacctacccaaatcctttaaaacggccccacccctatctcccttcgctggctgactctcttttcagactcagcccacctgcacccaggtgaaataaacagccctgttgctcacacaaagcctgtttggtatggtggtctcttcacacggacgcacatgaaa

SEQ ID NO: 198 - DNA, 831 bp, Homo sapiens
ttacagtaggtagctagtcagacatgagcagggcaggagagggctccaccaccaccaggaatgtcaggcgaccatcagctgatggtcaggcagttgtcaaccgtctctctaaaatgataattggatgcagccagcgccagggaaagggagggtcccagtagatagaaagaacctggaactgacgaccagcagcttcctggtaagatttcaggagttgggcacgtgggctcaagcatgtgcactaggaggcaaaacggtggcactaggaggcatgtgcactaggaggcaaaaccctcctctaggaaggctggactggtaagggaagaaaccaggaaataaatcacagaaacaaaccatctggtaaagaaaacacaaagaggaatgaagattaagggagggagagagggagggaggggaaatgctctttaatgagggtctctctcgcaacagaaacttccactgttacttcatttgagttctccagggagcgcgtgcacaacctcggtaaacacactgcgctccctcccaagggcttgcaggccaccctcagggaagaaccgggggaggagtaacgcaaaccccagaaccacgccaatgtacaaaaccccaagtcaaaagtcacacagcacgtttgatctccaagtcacccactggccctctcccaagtgtactttatttcctttcattccggtctaaagctttttaataaactttctctcctgctctaaaacttgccttggtctctcactctgcctgaggcccctcaaattctttcttctgaagaggcaggaagtgagggtgctacggacccatatggattcactgctgcga

SEQ ID NO: 199 - DNA, 430 bp, Homo sapiens
gtcaggcctctgagcccaagctaagccatcatatcccctgtgacctgcacgtatacatccagatggcctgaagtaactgaagaatcacagaagaagtgaaaatggcccattcctgccttaacttatgacatcccaccattgtgatttgttgctgccccaccttaactgagcgattaaccttgtgaaattccttctcctggcttagaaactcccccactgagcaccttgtgacccccacctatgcctgcaagagaaaaaccccttttgactgtaattttccactacccacacaaatcctataaaacggccccacccctatctcccttcgctgactctttctggactcagcccgcctgcacccagttgaaataaacagccttgttgctcacacaaagcctgtttggtggtctcttcacacggatgcgcgtga

SEQ ID NO: 200 - DNA, 4482 bp, Homo sapiens
tcacaaaagaagtgaaaatggccaattcctgccctaactgatgacattaccttgtgaaattccttctcccggctcagacgctcccccactgagcacctcatgacccccgcccctgcttgccggagaacaacccctttgactgtaattttccactacctacccaactcctataaaatggccccacccctatgtccctttgctgactctttttggactcagcctgcctgcacccaggtgattaaaaagctttattgctcacacaaagcctctttggtggtctcttcacacggacgcgcgtgacatttggtgtcgaaacatttggtgccgtgactcggattgggggacctcccttgggagatcaatcccctgtcctcctgctctttgctccgtgagaaagatccatctacgacctctggtcctcagaccaaccagcccaaggaacatctcaccaattttaaattgggtaagcggcgtctttttactgtcttctctgtcctctcactatccctcaacccctttctcctttcaatttctgcgccacctttcaatctctcccttcccttaatttcagttcctttctttttctggtagagacagaggagacgcgttttatccgtgaacctaaaactccggtgccagtcacagacttgggaagacagtctttcctttgtgtttaatcacgcggggacacctgcctgattattcagccacatttcagaggtgtctgatcaccatggggacgcctgccttgatccttcaccttggtggcaagcactacctccccgaggcggggcaagtaccctcccaccccttctctccatgtctctaccctctcttttctctgggcttgcttccttcactatgggcaaccttccaccctccattcctccttcttctcccttagcctgtgttctcaaaaacttaaaacctcttcaactcacacctgacctaaaacctaaatgccttattttcttctgcaacaccgcttgaccccaatacaaacttgacagtgtttccaaatagccagaaaatgtcacttttgatttctccatcctacaagatctagataattcttctcgtaaaatgggcaaatggtctgaggtgcctgacgtctaggcattctttttcacatcagtccctttctaatctctgctcccaatgcaactcgtcccaaatctttcttctttctctcctgtctgttccttcagtctccaccccaagctctgagtcctttgaatcctccttttctacagacctatatgacctctctcttcctccccaggctgccccttgccaggccgagccaggtcccacttcttcctcggcttctgctcctccaccctataatccttctatcacctcctctcctcacacccagtccggcttacagtttccttctgtgactagcccttccccacctgcccaacaatttcctcttaaagaggtgtctggagctaaaggcatggtcaaggttattgctcctttttctttatccagcctctcccaaatcagttagtgtttaggctttttttcatcaaatatgaaaacccagcccagtccgtggcttgtttggcaacaacccttagagactttaccttcctagacccagaaaggccagaaggccgtcttattctcaatatgcattttattacccaatctgctcctgacgtttaaaaaaagctccaaaacttaaattccagccctcaaaccccacaacaggatttaattaaccttgccttcaaggtgtacaataattaaaaagaggcagccaagcagcaatgtatttctgagttgcaattacttgcctctgctgtgagagaaaccccagccacatcttcagcacagaagaacttcaaaacgcctaagccacagtggtcaggcattccttcaggacctcctcccccaggatcttgcttcaagtgctggaaatctggccactgggccaaggaatgcctgcagcccgggattcctccttagtcatgtcccatctgtgcgggaccccactggaaatcgaactgtccaacttgcccggcagccactcccagagcccctggaattctggcccaaggctctctgactccttccccgatcttctcggcttagcagctgaagactgacactgcctgattgcctcaaaagcctcctggaccatcacaggcgcttgaggtaactcttacagtggagggtaaggccgtccccttcttaatcaatacagagactacccactccacattaccttcttttcaaggaccgtttcccttgcctccataactgttgtaggtattgatggccaggcttctaaacctcttaaaactccccaactctggtgccaacttagacaatattcttttttttttttttttttttttttggagatggagtctcactctgtcaccgaggctggagtgcagtggcgtgatctcggctcaataatacaagctccgtctcctgggttcacaccattctcccacctcaacctcctgaatagctgggatgacaggcgtccgccaccatgcccagctaattttttgtatttttaatagtgacggggtttcaccatgttagccaggatggtctcgatctcctgacctcgtgatctgcccgccttggcctcccaaagtgctgggattacaggcgtgagccatcgcgcccggccgcttagacaatattcttttgtgcactcctttttagttatccccacgtgcccagttcccttattaggtctaggcattttaactaacttatctgctttcctgactattcctaggctacagccacaactcattgccgcccttttccccagttcaaagcctccttcacatcctccccttgtgtctccccatcttaatccacaagtatgagacacctctattcctaccttggcgaatgatcatgcaccccttaacatcccattaaaacctaatcacccttaccccactcaatgccaatatcccatcccaccgcatgctttaaaaggttaaagcctgttatcactcacttgctacagcatgggcttctaaagcatataaactctccttacaattctcccattttacccatccaaaaaccagacaagtcttacaggttggttcaggatctatgccttatcaaccaaattgttttgcctgtccaccctgtagtgcccaacccgtacactcttgtcctcaatacctccctccacaacccatttttctgttctggatctcaagcatgcttcctttactattcctttgcacccttcatcccagcctctctttgctttcacttggactgaccctgacacccatcagtctcagcaacttacctaggctatactgccacaaggcttcaggaacagcccccattacttcagtcaagccgtttctcatgatttactttctttccatccatctgcttctcactttattcaatattttgacaaccttctactttatagcccctcctacaaatcttcccaaaaggacacccttctgctcctccaacatctgttctcaaaagaatatcgcgtatcctccttcaaagcccaaatttcttcctcatctgttacctatctcggcataattcttaataaaaacacacgttctctccctgctgatcgtgtctggctaatctcccaaaccctaaccccttctacaaagcaacaactcctttccttcctagcatggttaggtactttcacctttggatacctggttttgccatcctgactaaaccgttatataaactcacaaaaagaaacttagctgacctcatagatcctaaatcctttccccactcctctttcctttccttaaaaacagccctagaagctgcttccacactagctctccctaactaatcccaacccttttcattacacacagccgaagtgcagggctgtgcggtcagaattcttacacgagagccgggaccgtgccctgtagcctttctgtccaaacaacttgaccttactgttttaggctggcccccacattattcctgataccacacctgacccccatgaccgtgtctctctgatccacctggcattcactccatttccccatatttcattttttcctgttccccaccctgatcacagtttgtttttgtttttgtttttttgagatggagtcttgctttgtcgcccaggctggagtgcagtggcatgatctcggctcactgcaagctccgcctcccgggttcatgccattccctggcctcagcctcccaagtagctgggactacaggcacctgccatcatgcccggctaattttttttttttgtatttttagtagagacggggtttcaccgtgttagccaggaaggtccctaactcctgaccttgtgatccgcccgcctcggcctcccaaagtgctgggattacaggcgtgagccaccgtgcctggcccacagttggtttattaatggcagttccaccaggcttaatcgccactcaccagctaaggcaggctatgctatagtatcttccacatctgtca

SEQ ID NO: 201 - DNA, 4627 bp, Homo sapiens
gtcaggcctctgagcccaagctaagccatcatatcccctgtgacctgcacatccagacggcctgaagtaactgaagaatcacaaaagaagtgaaaatagcctgttcctgccttagctgatgacgttccaccacaaaagaagtgaaaatggcctgttcctgccttaactgattatattatcttgtgaaattccttctcctggctcgtcctggctcaaaagctcccccactgagcaccttgtgacccccatccctgcccaccagagaacaacccccctttgactaattttcctttacctgcccaaatcctataaaacagccccatccctatctcccttcgctgactctcttttcggactcagcccacctgcacccaggtgaaataaacagccttgttgctcacacaaagcctgtttggtggtcccttcacatggacgtgagtgaaatttggtgccctgactcggatcagcggacctcccttgggagatcaatcccctgtcctcctgctctttgctccgtgagaaagatccacctacgacctctggtcctcagactaaccagcccaaggaacatctcaccaattttaaatcaggtaagcggcctctttttactctcttctccaacctctctcattatccctcaacctctttctcctttcaatcttggtgccacacttcaatttctcccttctcttaatttcagttcctttccttttctggtagagacaaaggagacacgttttatccatggacccaaaactccggcaccagtcacagactcgggaaggcagtcttcccttggtgtttaatcattgcagggacacctgcctgattattcacccacatttaattggtgtctgatcactgcagggatgcctgccttggtcattcacccacattcccttggtggcaagtcaattgcggggacgcctgctttggctgctcactcacattgcagcccagggctgctcaccccaccccttctctccgtgtctctaccccttctccactttcctggggggcaagcaccccccaccccttctctctgtgtctctccccaccccttctccactttcctgggaggcaagcaccccccaccccttctctccatgtctctacccttctctttaaacttgcctccttcgctatgggcaaccttccaccctccattcctccttcttctcccttagcctgtgttctcaagaacttaaaacctcttcaactctcacctgacctaaaatctaagcatcttattttctactgtaatgtcacttgggcctgatacaaactcgagagtagttccaatagtcagagaatggcactttcaatttttccatcctataagatctagataattcttgtcataaaatgggcaaacggtctgagatgcctgacgtccaggcatttttttacacatcagtccctccctagtctctgttcccaatgcagcttgtcccaaatccttcttttcctcccgactgtcccctcagtcccaaccccaagcgtcgctgagactttctgatcttccttttctacagacccatctgacctctcccctcctccccaggctgctcctcaccaggccaagccaggtcctaatttttcctcggcctccgctcccccaccctataatccttttagcacctcccctcctcacgcctggtccggcttagtttccttccgcaactagctctcccccacctgcccagcaatttcctcttaaaaaggtggctggagctggccaggtgcagtgagtcagacctgtaatcccagcactttgggaggctgaggcaggcagataacaaggtcaggagattgagaccatgctgactaacacggtgaaaccccatctctactaaaaatacaaaaacttagccaggcatggtggcaggtgcctgtagtcccagctactcgggaggctgaggcaggagaatggcgtgaacctggaaggcagagcttgcagtgagccgagatcgtgtcactgcactccagcctgggcggcagagcaagactccatctcaaaaaaaaaaaaaaaaaaagggggctgccagctaaaggcatagtcaacgttaatgctctcttttctttatccgacctctcccaaatcagatagcgtttaggctctttttcatcaaatataaaaacccagcccagtccatggcccatttggcaacaacccttagatgttttactgccctagacccagaagggccagaaggccatcttattctcaacacgcattttattacccaacccactcccgacagtagaaaaagctccaaaaattagattccagtcctcaaaccccacaacaggacttaattaacctcgccttcaaggtgtacaataataaagtagaggcagccaagtagcaatgtatttctgagttgcaattccttgcctccactgtgagacaaaccccagccacatctccagcacacaagaacaccaaacacctgaaccacagctgccaggggttcctccaaaccctcttaccccaggagcttgctacaagtgccagaaatctggccactgggccaaggaatgcctgcagcccaggacccctcctaagctgtgtcccatctgtgtggaaccccactgaaaataggactgttcagctcgcctggcagccactcccagagcccctggaactctggcccaaggctctctgactgactccttcccagatcttctcagcttagtggctgaagactgatactgcccgatcacctcagaagcctacaggaccatcacagacgctttgggtaacttttacagtggagggtaagtctgtccccttcttaatcaatactgaggctaccaactccacattaccttcttttcaaggactgtttcccttgcccccataattgttgtgggtattgacggccaggcttctaaacctcttaaaactccccaactctggtgccaacttggacaatattcttttatacattcctttttatttaaccccacctgcccagttcccttattaggccgagacattttaaccaaattatctgcttcccttattattcctggactacagccacatctcattgccacccttcttcccaacccaaagcctccttcgtgtcttcctctcgtatccccccaccttaacccacaagtataggacacctctactccctccttggcaatggatgatgcaccccttaccatcccattaaaacctaatcacccttaccccactcaacgccagtatcccatcccacagcatgctttaaaaggattaaagcctgttatcactcccctgttacagcatggccttttaaagcctataaactctccttacaattccccattttacctgtccaaaaaccggacaagccttacaggtttagttcaggatctgcaccttatcaaccaaattgttttacctatccacctcatggtgacaaacccatatactctcctatcctcaatacctccctccacagcccattcttctgttctggatctcaaacatgctttctttactattcctttgcacccttcatcccagcctctcttcgctttcacttggactgaccctgacacccatcaggctcagcaaattacctgggctgtactgctacaaggcttcacagacagcccccattacttcagtcaagcccaaatttcttcctcatctgttacctatctcagcataattctcataaaaacacatgtgctctccctgctgatcgtgtctgactaatctcccaaaccccaatcccctctacagaacaacaactcctttcctttcctaggcatggttagtgtggtcagaattcttacccaagagtcgggaccgcgccctgtagcctttctgtccaacttgaccttactggtttagcctagccttcatgtctgcatgcagcagctgccgctgctttaatgcttttagaggccctcaaaatcacaaactatgctcaactcactctctacagttcccataacttccaaaatctattttcttcctcccacctggggcatataccttctgctccctggcttcttcagctatactcactctttgttgagtcttccacaattaccattgttcctggcctggacttcaatccagcctcccacattattcctgataccacacctgacccccgtgactgtatctctctgatccacctgacattcactccatttccccatattctttcctcttcctcaccctgatcacacttggtttattgacggcagttccaccaggcctaattgccactcaccagcaaaggcaggctatgctatagtatcttccacatgtatgattgaggctaccgctctgcccccttccactacctctcagcaagctgaactcattgccttaacttgggccctcactcttgcaaagggactacatgtcaatatttatactaactctaaatatgccttccatatcctgcaccaccatgctgttatatgggctgaaaggggtttcctcactactcaagggtcctccatcattaatccctctttaataaaaatgcttctcaaagctgctttacttccaaaggaagctggagtcattcactgcaaaggccatcaaaaggcatcagatccatggctcaggacaaagcttctgctgataaagtagctaaaaaagcagcta

SEQ ID NO: 202 - DNA, 376 bp, Homo sapiens
gtcaggcctctgagcccaagctcatatcccctgtgacctgcacctatacatccagatgacctgaagtaactgaagaatcacaaaagaagtgaaaatggccagttcctgccttaactgatgacattaccttgtgaaattccttctcctggctcatcctggctcaaaaagctcccccactgagcaccccactcctgcccgccagagaacaacccctctttgactgtaattttcctttacctacccaaatcctataaaacagccccacctctatctccctttgctgactctcttttcggactcagcccacctgcacccaggtgaaataaacagccttgttgctcacacaaagcctgtttggtggtctcttcatagggac

SEQ ID NO: 203 - DNA, 4831 bp, Homo sapiens
gtaggagattggtcagggtggtggaaaaaattgtagaaagacacaaaccttcttggacgtccaggaggttttataaaagctttggaaaagcatttggctgaaggcagccaaaccctcttatccggagcccgagagcgaaggttacataacaaggggatataaaggaattgatctagataagttagtttatttaggccttggaacctggcctttaatcatccacgtgcaggactgctctctccagggagggtgaccatgttaattacccacaagtgtgttgactcaaagcctttgtcattaaatctgtactaaataaatgccagcagcaccagcttgtcagggctgcggctgctacaactctttctgtcagcggtctggtcccttagcctactctttcactcaatacttgtgtctaagtacattctttcatccatcattcagccagggtctatgggtcagacccagcaggtggtgctccacatgaggaatgctgcaatggactgcgatagaaccctcaaaaatgaaggtgaaaagactgcgcagtcagtaagtcagtaagtcattggtgcccactcaggatttccaagttggagagaactgttcaggctagggtttcatcataggacaacagttatcagctcaacagcaacagtatataaaagcattgaaacagctgcttaaaggtagcagagccttggtttcgcaggctcaattaagagacctaatgcaaactactgtttcccataacccatggtttctgaaagaaggtgcactaaacttggagatctgggaacaagtgggtagaaatcttaaacaacatgatgtacaagggcaatgggtcccaataacatctttaacgttatgggctttagttagggtggctctggtcctactctacacagaagagcctaaaaagggaagggaggaagaactgtcacctaccttactgcctccatctccctcagccccgctgtctccaggaaaaaataacaaagaggaaatggaggttttgcctgaggcccctcatccaaaaaattggaaaaaagacaagggatatgctgtcttacgcaagcagcattagatggggagctcttagcctgcctggtaatgcaagatcaacaaggcaatcatttcttttaatgcttataaagagctaaaaaaaaaaaagcattaaagaaaacggagccactagcccatttacaagagggttaactgaggccactctgcagacctctttctaacaatggccactgttatttctcccctacccctaacgtggctctctcaaaatcctatttgggtagaacagtagcctttaaagggagagaaattataaagagcccatgaattagccgaggagcaattaaaagctgaccatatagaaccgtcatacagtccttgtaatttgcccattttcatcattccccaaaagtctggtaaatggagacttttgcatgacttacgtgctattgatgctaatttgcaacctatggggccccttcagcaggggctcccctcccacgtggcaattcctcgagactggcctataatcattattgacttaaaaggctgctcttatactattccccttgcagaacgggacagagaaaaatttgcatttacaataccagctatcaataatgaaaggccagctcactgatttcattggaaagtgcttcctcaaggaatgctgaacagtcctaccatgtgtcagtatcatgtaaatcaagcttggctccccagtagaaaagaatttcctaattgcaggattactcattttacagatgatattttactagcagccccaacagagctagtacttttcaagtcacatgcctctgtcgtaaagaatacacagttaagaggtttaatcatagaacctggaaaagtacagatgtctttctccttggaaatatcttgggtacatactaatttcccagtcagtaagacctcaaaaggttaaattaaatactagcaacttacataccttaaatgatgatcagaaattactaggtaatattaactggatttgccccaccttggacataactactgataagttacagaacttgttttccatcttaaaaggcaatgctgccctagactctcctaggtatttaactcctgcagcacaaagggaaattgaagagatagagcaagctatttctcagagacaactagattgcattgatacatggtattcagttcaattatttgtttttcccactaaacactcccctacagatgaccccagggctacgcttcctagaatgggttttttgctcacataccgggactaaaacactctttccctatatccagttagtcagtaaagtcatttattcaggatgcagatgatgcaatcagttgctaggttatgaccctgatatcatcaggattcctttaagtaaaaagcaattcaaggcagtattgccttatctatggacctgcaaatagcactctctgattacaaaggccatatagagcatgcccttcctgctgacaaactccttcagttcttatcttgtacttctgtggttttgcctactaaaacagttcaatcccccatatctaatgctttaacagtgtttactgatggctctggtaaacatggaaaagtcactttctggtggaaatcacgtaattccctcacttgttctggatttactagcgctcagagggctgagattggagccttactattggccttggaaactttttccattcagctcatcaatattgttagtgagtctgcttactctgtttatttattgcagaaccttgagagggccctcattaagtccactctggagcccaccctgtatgcactttttctccgacttcagcatttgctagatcaacatacacatcctatttttatcatacatatttgagcccacagctcactgcctggcccactggcttatgaccatgatcaagcagacgtacaagttagaacatcactgtttgaccaagccacccagtcacatcaatttttccaccaaaactggagaaacttatctgaacaatttcaacttacccagagactagctaaacaaattaaccggcaatgcccagattgccagctcacaggcacgttccctccttatacaggtgttaaccctagaggactagaacctaatcagttatggcaaacaccatgttacacatgtgcctgaatttgaaaaactaagatatgtacatgtatccattaataacaattctcaattagcgctcatgcctttcctggagagtccacccgatatgtcattaaacatcgtcttttaacttttgcatttatggggtggcctacaaaaattaaaactaataatggtctggcttatgccagctcacaatttcaacaattttgtcacagtggaatatccaacattccacaggcatcccttataacctccaaggagaggccatagtagaacatactcactctatccttaaaaatatgctcagaaaacaaaaaagggggaatatgagtaaggaccctgcaacactactagcacaagccttatttacccttaattttgaaaatttagatgataaatttcaattagctgtagaaaagcactttgctaaaacctctcaagacataaaacctgcagttttatggaaagatgtaaacagtaatgtacggtgtggtccaaatgaattgttaacatgtgggagaggatatgcttgtgttcacaccccctcaggtcctctttggattccagcacgatccatcaaaccttaccatagcatggctaggacccaacctggtaccagaaataaagaaaatgaccctataggacctacagccccagaaaatgtggcttcctcggacgacataggccctggacaggacgctgaagaagagaagtcagaagactgagcgaatctgctctggacacagacaccattcactccagataatttgttccttcctatgctttattaacctttttaattctttcactttacctgcaaccctcacctgctactctctattgggcccatctcttagatacgcctttcttcagccctattatttaaacaaacacccccttctcagcttctaacaacacgactgcttggctaagagggaatgacatgccccaagtggggttcctcaataacggcacacattggactaagatgccaagtaacactacatgtcactccttaattggaaaagaatgtggctaattatactcatatttgtcttctattatttactaattctaggatgcaaagccggaatgcgagcagtgcccgccacacctgacaaacctgctgctgcacacatctgtactcttcaatcaacaaaacctgatgctaaaaacagaaaagggggagatgtaggagatcagtcagggtggtgggaaaaattgtagaaagatgcaaaccttcttggaaggcggggaggttttacaacagcttcggaaatggatttggctgaaggtagccaaaccctcttatctggaccttgagagcaaaggttagatagcaaagagatataaaggaattgatctaggtaagttagtttaacttggaacctggcctttaatcatccccatgcatgactgctatctccgggcagggtgactatgttaattacgcaaaagtgtgttgactcaaagcctttgtcattaaatctgtaactaaataaatgcctgcagcaccagcttgtcagggctacagctgctgactctttacagcaccctgctcggggtctataagcagccaggtcctctagcccgctttttcactggatacctgcgtctgactgcattcttacatccgttgttcggccagggtctgcagattggacctggca

SEQ ID NO: 204 - DNA, 502 bp, Homo sapiens
gtaggagattggtcactgtggtgggaaaaattgtagaaagatgcaaaccttcttggaaggccgggagattttacaaaagcttcagaaaaggatttggctgaaggcagccagattctctcaccctgtgcctgaacgcttaggttagataacaaggagatgtaaagaaactgatctagataacttagtttacttagtagaacctggcctttaatcatctgagtgcaggactgctggggctgtgtgtgtgtgtggggtggggaaggggggaagcaccatgttaattacccaaaagtgtgttgactcaaggcctttgtcattaaatctgtataaataaatgcctgcagcaccagcttgtcagggccacagctgctacaactctttacaacaccctccttggggtacatgagcagccgagtctcctagcccactctcactggatacctgtgtctgagtgcatccgttcatccatcgcttggtcggggtctgtgggtcagacccagca

SEQ ID NO: 205 - DNA, 755 bp, Homo sapiens
gagaaacaggactagctggatttcctaggccgactaagaatccctaagcctagctgggaaggccgcatccacctttaaacacggggcttgcaactcagctcacacccaaccaatcagagagctcactaaaatgctaattaggcaaaaacaggaggtaaagaaatagccaatcatctattgcctgacagcacggcgggagggacaaggatcgggatataaacccaggcattcgagcgggcaacggcaaccccctttgggtcccctccccttgaatgggagctctgttttcactctgtttcactctattaaatcttgcaactgcactcttctggcccgtgtttgttagggctcgagctgagcttttgctcgccatccaccactgctgttttgccgccgtcgcagacccaccgctgacttccattcttccggatccggcagggtgtccgctgtgctcctgatccagcgaggcgcctattgccactcccgattgggctaaaggcttgccattgttcctgcatggctaagtgcctgggttcgtcctaattgagctgaacactagtcactgggttccacggttctcttccgtgacccacagcttctaatagagctataacactcactgcatggcccaagattccatttcttggaatccatgaggccaagaaccccaggtcagagaacacgaggcttgccaccatctcggaagcagcttgccaccatcttggaagctctgtgagcaaggaaccctggtaaca

SEQ ID NO: 206 - DNA, 772 bp, Homo sapiens
gagagacaggactagctggatttcctaggccaactaagaatccctaagcctagctgggaaggtgaccgcttccacctttaaacacgtggcttgcaacttagctcacacccaaccagtcaggtaggaaaaagagctcactaaaatgctaattaggctaaacaggaagtaaagaaatagccaatcatctatcgcctgagaacacagtgggcgggacaataatcgggggatataaacccaggcattccagccagcaactgctaccctctttgggtcccctccatttgtatgcgagctctgttttcactctatttcactctattaaatctcccaactgcactcttctggtctgtgtttgttacggctggagctgagctttcgctcgccgtccaccattgctgtttgccgccgccacagacctgccgctgacttccatccctccggatccggcagggtgtctgctgtgctcctgatccagtgaggcgccccttgccgctcccgattgggctaacggcttgagattgctcctgcacggctaagtgcccaggttcgtccttatcgagctgaacactagtcactgggttccatggttctcttccgtgacccacggcttctaatagagctgtaacactcactgcatggctcaagattccattccttggaatccgtgaggccaagaaccccaggtcagagaacatgaggcttgccaccatcttggaagtggcccactgccatcttgggagctctgggagcaaggaccccccggtaacagttt

SEQ ID NO: 207 - DNA, 115 bp, Homo sapiens
tggagtaggtaggtagacagacatgagcagggcagtagagaccccccagccctccaggaatgtcaggcgaccatcaggtgatggtcagttggttgttaactgtttctctgaaata

SEQ ID NO: 208 - DNA, 171 bp, Homo sapiens
ttacagtaggtagctagtcagatatgagcagggcaggaaagggccccctgcctcccactaggaatgtcaggcgaccatcaggtgatggttggaggttgttaaactgcctctctaaaataataattggtcgtagccagcgccagggaaaggcagtctcccaacagattaaaa

SEQ ID NO: 209 - DNA, 977 bp, Homo sapiens
gtggggaagagaaagagagatcagtgtctctttctatacggactgtgtctatatagaaagaagtagacatgagagactccattttgttctgtactaagaaaaattcttctgccttgagatgctgttaatctgtaaccctaccccaaccctgtgctcgcagaaacatgccctgtgtcgactcaaggtttaatggatttagggctatgcaggatgtgctttgttaaacaaatgcttgaaggcagctagcttgttaaaagtcatcaccactccctaatctcaagtacccagggacacaaaacactgcggaaggaaggccgcagggacctctgcctaggaaagccaggtttctccccatgtgatagtctgaaatatggcctcatgggaagtgaaagacctgaccgtcccccagcccgacacccgtaaagggtctgtgctgaggaggattagtaaaagaggaaggcctctttgcagttgagataagaggaaggcatctgtctcctgctcatccctgggcaatggaatgtctcggtgtaaaacccgattgtatattccatctactgagataggagaaaaccgccttagggctggaggtgagacatgctggcggtaacactgctctttaatgcaccgagatgtttatgtatgtgcacatcaaagcacagcaccttttccttaaccttgtttatgacacagagacatttgttcacattttcctgctggccctctccccactattaccctattgtcctgccacatccccctctgggagatggtagagatggtagagataatgatcaataaatactgagggaactcggagactggggccagcgtgggtcctctgtatgctgagcgccagtcccctgggcccatttttctttctctatactttgtctctgtgtctctttcttttctcagtctctcatcccaccccacgagaaacacccacagttgtggaggggcaggccaccccttca

SEQ ID NO: 210 - DNA, 971 bp, Homo sapiens
gtggggaaaagaaaaagagatcagactattactgtgtctatgtagaaagaagtagacataagagactacattttgttttgtattaagaaaaattcttctgccttgagatgctgttaatctgtaaccctacccccaaccctgtgctcacagaaacatgtgctgtgttgactcaaggtttaatgggtttagggctatgcaggatgtgctttgttaaagaaatgcttgaaggcagcatgcttgttaaaagtcaccacctctccctaatctcaagtacccagggacacaaaacactgcggaaggccaggccgcagggacctctgcctaggaaagccaggtattgtccaaggtttctccccatgtgatagtctgaaatatggcctcctgggaagagaaagacctgaccgtcccccagcccgacacccgtaaagggtctgtgctgaggaggattagtaaaagaggaaggcctctttgcagttgagatgagaggaaggcatctgtctcctgcccatccctgggcaatggggtgtctcggtgtaaaacccaattgtatgttccatctactgagataggagaaaactgccttaaggttggaggtgagacatgctggcagcaatacttctctttaatgcaccagatatgtttatgtatgtgcacatcaaagcacagcacattttctaaccttgtttatgacacagagacatttgttcacatgttttcctgatgacactctccccactataccctattgtcctgccacatccccctctctgagatggtagagataatgatcagtaaatactgagggaactcagagactggtgcccgcgtgggtcctctgtatgctaagcgccggtcccctgggcccagttttctttctctatactttgtctctgtgtctctttcttttctcagactctcgtcccccccagcgagaaacacccacaggtgtggaggggcaggccaccccttca

SEQ ID NO: 211 - DNA, 4587 bp, Homo sapiens
gtcaggcctctgagcccaagcaaagccagcatatgccctgtgacctgcacgtatacatccagatgacctgaagcaactgaagatccacaaaagaagagaaaatagccttaactgatgacattccaccattgtgatttgttcctgccccatcctaactgacatgatatagtctcccctgcccttaagaaggtgctttgtaatattctccccagcccttaagaatgtactttgtatgcctatcccaaacctataagaactaatgataatcctactaccctttgctgacttcttttttggactcagcccgccggcacccaggtgaaataaacagccttattgctcacacaaagcctgcttggtgctctcttcacacagacgcgtgtgacatttggtgccaaagacccgggacaggtggactcctttgggagatcagtcccctgtccttgccctcactccatgaggagacccacctacaacctcgggtcctcagaccaaccagcccaaggaacatctcaccatttcaaatcaggtaagcggtcttttcactgttctccagtctctcttgctacccttcaatctccctgtccttccaattccagctctttttcctctctagtagagacaaaagagatacattttatccatggacccaaaactccagcgtcggtcacggactcgggaagacagtcttcccttggtgtttaatcactgtggcgatgcctgcctgaatattcacccacactccattgatgtctgattaccgtggggacgcctgccttggtcattcacccacattacctcagtggcaggtcaattgcggggacacctgctttggctgctcatccacattgcagcccagggctgctcaccgccccccactgccccttctccgtgtctctacctttctctttaaactcacctccttcactatgggcaaccttccgccctccattcccccatcttctcccttagcctgtgttcttaaaaacctaaaaccccttcgactcacacctgacctaaaacctaaacactttattttcttctgcaatactgcttggccccagtacaaactcgacagtagttccaagtagccagaaaacggcacttttgatttctccattttacaagacctggatgatttttgtcgaaaaatggacaaatggtctgaggtgcctgacgtccaggcattcttttacacatcagtccctccctagtctctgttcccaatgtgactcatcccaaatctttcttctttctctcctgtctgttccttcagtctccaccccaagttctgagtcctttgaatccttcttttctatggactcatctcacctctccccttctcgccaggctgctcctcaccaggccgagccaggtcccaattcttcctcagcctctgctcccccactgtataatcctcctatcatctcccctcctcacacccggtctggcttacagtttcgttccacgactagccctccctcacctgcccaacagtttcctcttgaagaggtggctagagctaaaggcatagtcaaggttaatgctccttttttctttatccgacctctcccaaatgagttagcatttaggctctttttcgtcaaatataaaaacccagcccagttcatggcctgtttggcaacaacccttagacactttactgtcctagaccccagaggaaggctgtcttattctcaatatgcattttattacccaatctgctcccgacattagaaaaagctccaaaaattagattccagccctcaaaccccacaagaagacctaattaacctccccttcaaggtggtatacaataatagaatagaggcagccaagtggcaacgtatttctgagttgcaattacttgcctccactttgagagaaaccccagccacatctccagcatacaagaacttcaaaacgtctgaaccacagtagccaggtgttcctccaggactgcctcccccaggagattgtttcaagtgctggaaatctggccactgggccaaggaatgctcgcagcctgggattcctcctaagccatgtgccaactgtgcaggaccccactggaaattggactgtccaactcgcccggcagccactcccagagcccctggaattctggcctaaggctctctgactgactccttcccagatcttcttggcttagcagctgaagactgatgccgcccgatctccttggaggccccccggacaatcactgatgccgagctttgcgcaactcttacagtggagggtaaggccgtcctcttcttaattaatatggaggctaccaactccacattaccttcttttcaagggcctgtttcccttgcctccataactgttgtgggtattgacggccaggcttctaaacctcttaaaactccccaactctggtgccaacttgaacaacattccttaatgcagtccttttgagttatccccacttgcccagctcccttattaggtcgagacattttaactaaattatctgcttccctgactattcctgggctacagccgtacctcattgccgcccttttccccagttcgaagtctccttcacatcctcaccttgtatctccccaccttaatccacaagtatgggatacctctactccctctttggcaaccgatcatgtgccccttaccatcccattaaaacctaatcacccttacccagctcaacgccaatatcccatcccacaacaggctttaagaggattaaagcctgatatcacttgcctgctacagtatggccttttaaagcctataaattctccttacaattctcacattttacctgtccaaaaaccggacgagtcttacaggttagttcaggatctgaaccttatcaaccaaattgtcttgcctatccaccccgtggtgccaaacccatatactctcctatcctccacacctccctccacaacccattattctgttctagataaacctagctgaccccataaatcctaaatccttcccctactcccctttccattccttaaaaaacagccctaaaagctgctctcacactagctctccctaactcatcccaacccttttcattacacacagccgaagtacagggctgtgtggtcagaattcttacacaagaaccgggaccgcgctctgtagcctttctgtccaaacaacttgaccttactgttttagcctagccatgtctgcgtgtggcggctgccactgctttaatacttttagaggccctcaaaatcacaagctatgctccacttactctctacagttctcataactttcaaaatctattttcctcctcacacttgatgcatatactttctgcccctcagctccttcagctatactccctctttgttgagtctcccacaattaccattgctcctggcccagacttcaatctggcctcccacattattccggataccacacctgatccccatgactgtatctctcatccatgtgacagtcactccatttccccatatttccttctttcctatttctcatcctgatcacacttggtttattgatggcagttccaccagggctaattgccactcaccagcaaaggcaggctatactatagtattttccatgtttatcattgaggctaccactctgcccccctccactacttctcagcaaaccgaactcattaatctctcccactctaggttcccatgctgcccctaatccctttcaaagcagccctgagaacatcacccattatctctccataccacccccaaaaattttcgccaccccaacacttcaccactattttgttttgtttttcttattaatataagaagacagggatctcaggcctctgagcccaagcaaagccatcatatcccctgtgacctgcaggtatacatccagatggcctgaagcaactgaagatccacaaaagaagtgaaaatagccttaattgatgacattccacccttgtgatttgttcctgccccaccctaactgatatgacatagtctctgccgcccttaaaaaggtactctgtaatattctcccctgcccttaagaaggtactttgtaatattctcccctgcccttaagaaggtattttgtaatattctccatgcccttaagaatgtactttgtacgcctatcctaaacctataagaactaatgataatcgggcaggcacggtggctcacgtctgtaatcccagcatttggaaggccgaggtgggtggatcatgaggtcaggagatcaagaccacggtgaaaccctgtctctactaaaaatacaaaagaaaaaaaattagccaggcatggtggcgggcgcctatagtcccagctactcaggaggctgaggcaggaaaatggcatgaacccgggaggcagagcttgtagtgaaccaagactgagccactgcactctagcctgggcaacacagcaagactctgtctcaaaaaaaaaaaaaaaaagaactaatgataatcccaccaccctttgctgactcctttttggactcagcccacctgcacccaggtgaaataaacagccttgttgctcacagaaagcctgtttggtggtctcttcacaaggatgcgcgtga

SEQ ID NO: 212 - DNA, 465 bp, Homo sapiens
gtcaggcctctgagcccaagctaagccatcatatcccctgtgacctgtaggtacacatccaaatggcctgttcctgccttaactgatgacattccaccacaaaaggagtgaaaatggctggcccttgccttaagtgatgacattccaccacaaaataagtgaaaatggctggtccttgccttaactgatgacattaccttgtgaaatcccttttccgggctcatcctgactcaaaaagctcccccactgagcaccttgtgaccccccatgcctgcctgccagagaacaagccgcctttgactgtaattttcctttacctacccaaatcttataaaacagccccacccctatctcccttcgctgattctctttttggactcatcccgcctgcacccaggtgattaaaaagctttattgctcacacagagcctgttttgtggtctcttcacatggacgcgcgtgaaa

SEQ ID NO: 213 - DNA, 212 bp, Homo sapiens
ttacagtaggtagctaggcaggcatgagcagggcggtggagggctccccctcaacacacaccaggagtgtcaggcaaccagcaggtgatggtcaggcggttgttaactgtttctctgaataattggtcacagccagcggcagggagaggtagtctcctaatagatagaaaacatctgaaactggtcagcagcttcccaataagatctcagga

SEQ ID NO: 214 - DNA, 861 bp, Homo sapiens
tttccttcttcggtggctagctatcctgaggggaggaaactatgtcctcatgcctgcagctaaccattggaaattacttaaaacccttcaccaaacctttcacttaggtattgataacacccatcagatggccaaatcattatttactggacgaggccttttcaaaactgtcaagcagatagtcagggcctgtgaagtgtgccaaagaaataatcccctgcactgcaggctatacatttaaatccctgtatctttaacctccttgttaagtttgtctcttccagaatcaaagttgtaaaactacaaattgttcttcaaatgaagccccagatgcagtccatgactaagatccaccgcggacccctggacaggcctgctagcccatgttccgatgctagtgacatcgaaggcacccctcccgaggaaatctcaactgcacgacccctactatgcgccagttcagcaggaaacagttagagtggttgtcggccaaccttcccaacagcacttgggttttcctgtcgagagggggaactgagagacatgactagctggatttcctaggccgactaagaatccctaagcctagctggggaggtgaccgcatccacctttaaacacggggcttgcaacttagctcacacccaaccaatcaggtagtaaagagagttcactaaaatgctgattaggcaaaaacagaaggtaaataaatagccaatcatctatcacctgagagcacagggcgggggacaatgatcgggatataaatccaggcattcgagcaggcaacggcaaccccctttgggtcccctcccattttatggaagctctgttttcactctattaaatcttgcaactgca

SEQ ID NO: 215 - DNA, 7309 bp, Homo sapiens
cccctttgggtcccctccttatatgggagctctgttttcactctatttcactctattaaatcttgcaactgccctcttctggtccatgtttgttacggctcaaactgagctttcgctcgccgtccaccactgttgtttgccgccttcgcagacccgccgctgacacccatccctctgaatccggcagggtgtctgctgtgctcctgatccagtgaggcgcccattgccactcccgattgggctaaaggcttgccattgttcctgcatggctaagtgcctgggttcgtcctaatcgagctgaacactagtcactgggttccatggttctcttccgtgacccacgacttctaatagagctataacactcaccgcatggcccaagattccattccttggaatctgtgaggccaagaaccccaggtcagagaacacggggcttgccaccatcttggaagtggcccgccgccattttggaagtggcccaccaccatcttgggagctctgtgagcaaggaccccccggtaacattttggcgaccacgaagggacctccaaagcggtgagtaatatcggaccactttcacttgctattctgtcctatccttccttagaactggaggaaaataccaggcacctgtcggccagttaaaaacgattagcatggccacaggacttaagactcaggtgtgaggctatctggggaagggatttctaacaacccccaacccttctattggggacgttggtctgcctcgcgccggcttccactttcagttttcttggggaagccaagggccgcctagagacagaaagctgttgtcctgaactcccggcagtagccggttgagatcatggcacagccagaagtctctactcagcagtcgcctgtgcatgcgccccacctttccttctgacccatacctcctgggtcccgaccacgactttcttgaaagtgtagccccaaaattctccttacctctgaatctacttcctctgatccctgcctcctaggtactaatggttcagactttcatttcctctagcaagtcgtatctccaaggggatctaaggaagctctacgctgcgtccttaggcagctagactataacccaggcagtcttatccctggtgtccctcccgatttaggtatacagctcttgacatgggcagttatgggcagttatgtgggacccgttccccaccacccttgccagggccccaagtttgtaatggctaagagagagagactgagagagcgagagagagagacggagagagagagatggagagagggacaaagacagagtcaaagacagaaagaaagaaaaagatagaaatagttttaaaaaaaaagtgtgccctattcctttaaaagccagggtaaatttaaaacctgtaattgataattgaaggtcttctccgtgaccctataacacttcaatgccactttgttgtcaatgtaaataagggcgtagcccaaaagcactgaggccactgacaacctgtagctttcctatcaaaaatccttaacccagtaacccgcggatgggccaaatgcattcggtcggtagcggcaattgctttgctaaaagtagaaaaggaactttttgaggaaacttcgttgacagcacacctcaccagttaaactattctaagtcaaaaaaaaaaaaaaagcaaaaaggtagcttactaaatcaaaaatcttaaagtatggggctattgtgttagaaaagggtaatgtaactccaaccactgataattcccttaacccagcagatttcctaacaggggatttaaatcttaattaccatacaaaggtccgaccagacctaggaggaactcccttcaggaccggaggatagatggttcctcccaggcgattgaggagaaaaccacaatgggtattcagtaattgatacagagactggtgtggaagcagagtgagaaaaattgcctaataattggtctcctcaaacatgtgagctgtttgcactcagccaagccttaaagtacttacagaatcaaaagactatctcaatcctgaatcaaaaggttcgctacaccctctctgaaatgaatttacataagaattgttttttataggaatgcatcttgatggggcagctgggttgttatgaaatactcaagaacccagcccagctctaggactcacccctgagtgcaaaggcaatgttgggcacgctggcaaaggaccactagaatccagcagcccagacccctttgtttgtggtcaagagaggcgggaaaacaggtgcaggactgctacattggtgagcataactaatccgataagcagaggtccatgggtggttacgcaccctggaaaggatctcacccctgagcccaaaggcaatgttgggcacgctggtaaaggaccactagaatccagcagcccggacccctttctttgtggtcaagagaggcgggaaaacaggtgcagaactgctacatcagttagcataactaatccaataagcagaggtccatgggtggttatgcaccctggaaaagaataaacattaggcccttagaggatgctctaggactaacgctcgatggaaaatgactaagggtgctggcacccctatgtccttttttcagatgggaaatgttccccccaccccaaggcagaaatgcccctgagatgtattctggagaattaggaccaatttgaccctcagacgctaagaaagaaatgacttatattcttctgcagtaccgcctggccacgatatcctcttcaaggggcagaaacttggcctcctgagggaagtataaattataacaccatcttacagccagacctcttctgtagaaaggagggcaaatggagtgaagtgccatatttgcaaactttcttttcattaagagacaactcataattatgtaaaaagtgtggtttatgtcctacaggaagccctcagattctacctccctatcccagcatccccctgactccttccccaaataataaggaccccccttttacccgaatggtccaaaggagatagacaaatggataaacgatgaacaaaacagtgccaatattccctgattttgccccctccaagcagtgggaggaggagaatttggcccagccagagagtgcatgtatctttttctctctcagacttaaagcaaattaaaatagacctaggtaaattctcagataaccctgatggctatattgatgttttacaaaggttggggcaatcctttgatctgacatggagagatatcatgttactgctaaatcagacactaaccccaaatgagagaagtgccgccataagtgcagcctgagagtttggcaatctctggtatctcagccaggtcaatgataggatgacaacagaggaaagaacgattcaccacaggccagcaggcagttcccagtgtagaccgtcactgggacacagaatcagaacatggagattggtgccacagacattcgctaacttgcgtgctaggactaaggaaaactaggaagaagcttatgaattattaaatgatatccactataacacccactataacagggaaaggaagaaaatcctactgcctttctggagagactaagggaggcattgaggaagcatacctctctgtcacctgactctattgaaggccaactaatcttgaatgataagtttatcactccgtcagctgcagacattagaaaaaacttcaaaagtccaccttaggcccagagcaaaacttagaaaccctattgaacttggcaacctcggttttttataatagagatcaggaggagcaggcagaatgggacaaacgggatttaaaaagggccaccgctttagtcacggccctcaggcaatcagactttggaggctctggaaaagggaaaagctgggcaaatcaaatgcctaatagggcttatttccagtgtggtctacaaggacactttaaaaaagattgtccaagtagaaataagccaccccctcgtccatgccccttatgtcaagggaatcactggaagacccattgccccaggggatgaaggtcctctgagtcagaagccactaaccagatgatcctgcagcaggactgagggtgcccagggcaagcaccagcccatgccatcaccctcatagagccctgggtatgcttgaccattgagggccaggaggttaactgtctcctggacactggcacggccttctcagtcttactcgcctgtcccggacaactgtcctccgcatctgtcactatccaaggggtcctaggacaggcagtcactagatacttctcccagccactaaattgtgactggggaactttactcttttcacatgcctttctaattatgcctgaaagccccactcccttgttagggagagacattgtagcaaaagcaggggccattatacatctgaacgtaggaaaaggaacacctgtttgttgtcccctgcttgaggaaggaattaatcctgaagtctgagcaacagaaggacaacatagatgagcaaagaatgcccatcctgttcaagttaaactaaaggattccacctcctttccttactgaaggcagcaccccctcagacccgaggcccaacaaggactccaaaagattgttaaggacctaaaagcccaaggcctagtaaaaccatgcaatagcccctgcaatactccaattttaggagtacagaaacccaatggacagtggaggttagtgcaagatctcaggattatcaatgaggctgttgttcctctatacccagctgtacctaacccttatactctgctttcccaaataccagaggaagcagagtggtttacagtcctggaccttaaggatgcctttttcggcatccctgtacatcctgactctcaattcttgtttgcctttgaagatccaatgtctcaactcacctggactgttttaccccaagggttcaaggatagcccccgtctatttggccaggcattagcccaagacttgagccaattgtcatagctggacattcttgttcttcagtatggggatgatttaattatagccacccattcagaaaccttgtggcatcaagccacccaagcgctcttaaatttcctcgctacctgtggctccaaacaaaaggctcagctctgctcacagcaggttaaatacttagggctaaaattatccaaagtcaccagggccctcagagaggaacgtatccagcgtatactggcttatcctcatcccaaaaccctaaagcaactaagagggttccttggcataacagccttctgccgaatatggattcccagatacagtgaaatagccaggccattatgtacattaattaaggaaactcagaaagccaatacccatatagtaagatggacacctgaaacagaagtggctttccaggccctaaagaaggccctaacccaaaccccagttgtaagcttgccaacggggcaagacttttctttatatgtcacagaagaaacaggaatagctctaggagtccttacgcaggtctgagggatgagcttgcaacccgtggtatacctgagtaaggaaattgatgtagtggcaaagggttggcctcattgtttatgggtaatggtagcagtagcagtcttagtatctgaagcagttaaaataatacagggaagagatctttctgtgtggacatctcatgatgtgaacggcatactcactgctaaaggagacttgtggctgtcagacaaccgtttacttaaatatcaggctctattacttgaagagccagtgctgcgactgcgcacttgtgcaactcttaacccagccacatttcttccagacaatgaagagaggaaagaacataattgtcaacaagtaattgctcaaacctatgccactcaaggggaccttttagaggtgcccttgactgatcacgacctcaacttgtatactgatggaagttcctttgtagaaaaaggacttcaaaaagcagggtatgcagtggtcagtcgtaatggaatacttgaaagtaatcccctcactccaggaactagtgctcagctggcaaaactaatagccctcactcaggcactagaattaggagaagggaaaagggtaaatatatatacagactctaagtatgcttacctagtcctccatgcccatgcagcaatatggagagaaagggaattcctaatttccgagggaatacctatcaaacatcaggaagccatcaggagattactattggctgtaccgaaacctaaagaggtggcagtcttacactgccggggtcaccaggaaggaaaggaaagggaaatagaaaggaaccaccaagcggatattgaagccaaaagagccacaaggcaggaccctccattagaaatgcttatagaaggacccctagtatggggtaatcccctccaggaaaccaagccccagtactcggaagaagaaatagaatgaggaacctcatgaagacatagtttcctcccctcaggatggctagccaccgaagaaggaaaaatacttatgcctgcagctaaccagtggaaattacttaaaacccttcaccaaacctttcacttatgcattgatagcacccatgagatggccaaattattatttactgcaccaggccttttcaaaactatcaagcagggcctctatagtgtgccaaagaaataatcccctgcattgcagaccatacatttcaatccctgtatctttaacctccttgttaagtttgtctcttccagaattgaaactgtaaaactacaaatcattcttcaaatggagccccagatgcagtccatgactaagatccactgcagacccctgatcaacctcctagcccatgctccaatgttaatgacattgaaggcacccctcccgaggaaatctcaactgcacaacccctactatgacccaattcagcaggaagcagttagagcagtcatcagccaacctccccaacagcacttgggttttcctgttgagaggggggactgagagacaggactagctggatttcctaggccgactaagaatccctaagcctagctgggaaggtgaccgcatctacctttaaacatggggcttgccacttagctcacacccaaccaatcagagagctcactaagaagctaattaggcaaaaataggaggtaaagaaatagccaatcatcaattgcctgagagcacagtgggagggacaaggatccggatataaacccaggcatttgagacagcaatggcaatcccctttgggtcccctccttgtatgggagctctgttttcactctatttcactctattaaatcttgcaactgca

SEQ ID NO: 216 - DNA, 951 bp, Homo sapiens
gtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttca

SEQ ID NO: 217 - DNA, 441 bp, Homo sapiens
gtcaggcctctgagcccaagctaagccatcgcatccccggtgacttgcacatatacgcccagatggcctgaaataactgaagaatcacaaaagaagtgaaaatgccctgccccgccttaactgatgacattccaccacaaaagtgaaaatggccggtcctcgccttaagtgatgacattaccttgtaaaagtccttttcctggctcatcctggctcaaaaagctcccctgagcaccttgccccactcctgcccgccagagaacaactcccctttgactgtaattttcctttacctacccaaatcctataaaacggccccacccctatctcccttcgctgactctcttttcggactcagcccgcctgcacccaggtgattaaaagcttttattgctcacacaaagcctgtttggtggtctcttcacacggacgcgcatgaaa

SEQ ID NO: 218 - DNA, 5839 bp, Homo sapiens
caggcctctgagcccaagccaagccatcgcatcccctgtcacttgcacgtatacacccagatggcctgaagtaactgaagaatcacaaaagaagtgaatacgccctgccctccttaactgatgacattccaccacaaaagaagtgcaaacggccggtccttgccttaactgatgacattaccttgtgaaagtccttttcctggctcatcctggctcaaaaagcacccccactgagcaccttgcaacccccactcctgccctccagagaacaacccccctttgactataattttcctttacctacccaaatcctataaaacagccccacccctaactcccttcgctgactctctttttggactcagcccgcctgcacccaggtgaaataaacagccacgttgctcacacaaagcctgtttggtggtctcttcacacggatgcgcatgaaatttggtgctgtgactcggattgggggacctcccttgggagatcaatcccctgtcctcctgctctttgctccatgagaaagatccacctatgacctcaggtcctcagactgaccagcccaagaaacatctcaccaatttcaaatccggtaagtggcctctttttactctcttctccaacctccctcactatccctcaacctctttctcctttcaatcttggcgccacacttcaatctctcctttctcttaatttcaattcctttcattttttggtagagacaaaggagacacattttatccgtggacccaaaactccggcgccggtcacggactgggaaggcagctttcccttggcgtttaatcattgcagggacacctctctgattattcacccacgtttcaagggtgtcagaccacgcagggatgcctgccttggtccttcacccttagcagaaagtcccgcttttcaggggaaggggcaagtaccccaaccccttctctccttgtctctaccccttctctgcttttccagggaaaaggcaagtaccccttctctccttgtctctaccccttctctgcttttctggggaaagggcaagtaccccaaccccttctctccatgtctctaccccttctctgcttttctgggggaggggcaagtacccctcaaccccttctccttcacccttagcggcaagtcctgctttcctagggggcaagaactccccaatcccttatttctgaaccccgacctcttatctctgtgccccaatcccttatttctgaaccccaacctcttatctctgtgccccaattccttatttccatggcccaaccctttctctgcttttctggagggcaagaaccccccacctcttcctgtgtctctactcttttctctgggcttgcctccttcactatgggcaagtttccaccttccattcctccttcttctcccttagcttatattcttaagaacttaaaacctcttcaactctcacctgacctaaaatctaagcatcttattttcttctgcaatgccgcttgaccccaatacaaacccgacagtagttccaaatagccggaaaatggcgctttcaatttttccatcctacaagatctaaataattcttgtcataaaataggcaaatggtctgaggtgcctgatgtccaggcattcttttacacatcagtcccttcctagtctctgtgcccagtgcagctcatcccaaaccttccttctttccctcctgcctgtcccctcagtcccaaccccaagcgtcgctgagtctttctaatcttccttttctacagacccatctgccctctcccctcctcgccaggccaaactaggtcccaattctccctcagcctccactcctccaccctgtaatctttttattacctcccctcctcacacctggtcctgcttacagtttcattctttgactagccctcccccacctgcccagcaatttactcttaaaaaggtggttggagccaaaggcatagtcaaggttaatgctcctttttctttatcccaaatcagaagcatttaggctcttttttatcaaatataaaaacccagcccagttcatggctcgttcagcagcaaccctgagacactttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataacataaaaaagttgcaattccttgcctccactgtgagacaaaccccagccacatatccagcacacaagaacttccaaatgcctgaaccacagcggccaggcattcctccagaacctcctcccccaggagcttgctacaagtgccagaaatctgaccaccaggccaaggaatgcctgcagcccaggattcctcctaagccatgtcccatctgtgcgggaccccactggaaattggactgttcaactcacctggcagccactcccagagcccctggaactctggcccaaggctctctgactgactccttcttggcttagcggctgaagactgatgctgcctgattgcctcagaagcccggtagaccatcacggatgccgagctttaagtaactctcacagtggagggtaagtccattcccttcttaatcaatacagaggctacccactccacattaccttcttttcaagggcctgtttcccttgcctccataactgttgtgggtattgacagccaggcttctaaacctcttaaaactcccaactctggtgccaaattagaggatactcttttatgcactcttttttagttatccccacctgcccagttcccttattaggctgagatattttaaccaaattatctgcttacctgactattcctggactatagccgcatctcattgctgcccttcttcccaatccaaagcatcctttgcatcctcctctagtattcccccaccttaacccagaagtataagatacctctactccctccttggtgactgatcatgcaccccttaccatctcattaaaacctaatcacccttaccccactcaatgccaatatcccatcccacagcatgctgtaaaaggattaaagcccgttatcacttgcctgctacagcatgggcttctaaaacctataaactctccttaccattcccccattttacctgtcctaaaaccagacaaggcttacaagttagttcagaatctgtgccttatcaaccaaattgtttcgtctatccaccccatggtgccaaacctgtatactctcctatcctcaatagctccctctactacccattattctgttctggatctcaaacatgctttctttactattcctttgcacctttcatcccagcctctctttgccttcacttagactgaccctgacacccattaggctcagcaaattacctgggctgtactgcctcaaggcttcacagacagcccccattacttcagtcaagcccaaatttcatcctcatctgttacctatctcagcataattctcataaaaacacacgtgctctccctgctgatcatgtctgattaatctcccaaacctcaatcccttaaaaaagagcaactcctttctttcctaggcatggttagtgcggtcagaattcttacacaagggccaggaccacacagtgtaggctttctgtccaaacaacttgaccttactgttttagcctagccctcatgtctgcgtgcagcagctgccactgctttaatactgttagaggccctaaaaatcacaaactatgctcaactcactctctacatttctcataacttccaaaatctattgtcttcctcatacctgacacatatactttctgctccccagctccttcagctgtactcactctttaagtcccacagttaccattgttcctggcccagacttcaatctggcctctcacattattcctgataccacacctgacccccatgactgtatctctctgatccacctgatattcaccccatttccccatatttccttcttttctgttcctcaccctgatcacgcttgatttattgatggcagttctaccaggcctaatcaccacacaccagcaaaggcaggctatgctatagtacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgctgccactcaggactggcaaattagcttactcaacatgccctgattcaggaaactaaaatacctcttagtctaaatagacactttcactgaataagtaaaggcctttcctacagggtctgagaaggccaccacagtcatttcttccctcctgtcagacataattcctcagtttagccttcccacctctatacagtctgataacagaccagcctttattagtcaaatcagccaagcagtttttcaggctcttagtattcagtgaaacctttatatcccttacggtcctccatcttcaagaaaagtagaatggactaaaggtcttttaaaaacacacctcaccaagctcagctaccaacttaaaaaggactggacaatacttttaccactttcccttctcagaattcaggcctgtcttcggaatgctacagggtacagcccatttaagctcctgtatagatgctcctttttattaggccccagtctcattgcagacaccagagcaacttagactgtgccccagaaaacttgtcatccctgctatcttctgtctagtcatactcctatttaccgttctcaactactcatacatgccctgctcttgtttacactgccagtttacactgtttttccaagccatcacaggtgatatttcctggtgctatccccaaattgccactcttaactcttgaagtaaataaataatctttgctggcaggactctgctgaatctccttaggcattctctaatcagatatcctgagtcgtcccaattcttagaccttttatacctgtttttctccttctcttattccatttagtttctcaattcatccaaaaccatatccaggccatcagcaatcattctgtatgacaaatgtttcttgtaacatccccacaatatcaccccttaccacaagacctcccttcagcttaatctctcccactctaggttcccacacagcacctaatcccgcttgaagcagccctgagaaacatcgtccactctctctccataccacccccccaaaatttttgccaccccaacacttcaacactattttgttttatttttcttattaatataagaaggcaggaatgtcaggcctctgagcccaagccaagccatcgcatcccctgtcacttgcacatatatgcccagatggcctgaagtaactgaagaatcacaaaagaagtgaatatgccctgccccaccttaactgatgacattccaccacaacagaagtataaatggctggtccttgccttaagtgatgacattatcttgtgaaagtccttttcctgctcatcatggctcaaaaagcaccccccactgagcaccttgtgacccccactcctgcccgccagagaacaacctccctttgactgtaattttcctttacctacccaaatcctataaaacggccccacccctatctcccttcactgactctcttttcggactcagcccacctgcacccaggtgaaataaacagcctcgttgctcacacaaagcctgtttggcggtctcttcacatggatgcgcatgaaa

SEQ ID NO: 219 - DNA, 700 bp, Homo sapiens
ttatagtaggtagcttgtcagacatgagcagggcagggcagggctcctgccacccccagccaggaatgtcaggtgaccatcaggtaatggtcaggcagttatttctctaagatagtaattggctgcagcctgtgccagggaaaggcagtctcccaacagatagaaacacctgaaactggtgatcagcagcttcctgaaaagatctcaggagttaggtgagtgggttcaagcatgcgcactaagaggcaaaatggcagagtttaactggtacatgaccttctaggaacattccactggtaagggaaggatatgcctcaagtgagcatgggtacgactccagtaaacacactgtgcatgtggcccctcccaggtactggaaggccactgcaaatgcttacagaccaccccaagggaagaacagcaggggagaagtcatgcagaaagagagccaacataagaaaccccaagtcaaaggtcgaaccgtgcactggctctctccagtcgcctgcttggccctcttccaagtgtactttacttccttttgttcctgctctaaagttttaaataatatttcgctcctgctctaaaacttgccttggcctctcactctgcattatatccttcagttgaattctttcttctgaggagtcaagaattgaggttgccgcagacacctgtggatttgctgccagtaacaaaa

SEQ ID NO: 220 - DNA, 357 bp, Homo sapiens
actgaattaccacaaaagaagtgaaaatagccagttcctgccttaactgatgacattccaccgttgtgatttgtttctgccccaccctaactgatcagttgaccttgtgacattccttctcctggacaatgagtctcagaagctcctcactggccaccttgtgacccctgcccgcaagagaaaaaccccctttaactgtaatttgccactacctacccaatcctataaaactgccccacccctatctccctttgcagactccttttgcggactccgtctgcctgcacccaggtgattaaaaagctttattgctcacacaaagcctgtttggtggtctcttcacagggatgtgtgtga

SEQ ID NO: 221 - DNA, 5594 bp, Homo sapiens
caggattccacggatggcccaaatgcattcaatctgtagcagcaactgctttgttaacagaagaaagtagaaaagtaatttttgaggaaacctcattgtgagcacacctcaccagtttagaattattctaagtcaaaaaagcaaaaaggtagcttactaactcaaaaatcttaaagtatggggctattttgttagaaaaaggtgatttaacattaaccactgaaaattcccttaacccagcagattttctaacaggggatttaaatcttcattaccatacaaaggtccaaccagacctagtaggaactcccttcagaacaggatgatagatggttcctcccgggtgattgagggaaaaaaaaccacaacgggtattcagtaattgatagggagactcttgtggaagcagagttaggaaaattgcctaataattggtctgctcaaacaagagctgtttgcactcagccaaaccttaaagtacttacagaatcgaaaagagtctatctcaatcttgactcaaaatgttacctacaccctctctgaagtgaatttgcataagaactattgtttatgggaatgcatcttgatggggcagctaggttgttatgaaatactcaggaactcagcccagctctagaactcacctctgagcgcaaaggcaatgttgtgcacactggtaaaggaccactagaatccagcagcccggacccctttatctgtggtcaagaaaggtgggaaaacaggtgcacgactgctacattggtgagcataactaatccgataagcagaggtccatggatggttacgcaccctggaaaggaataagcattaggaccatagaggacactctatgactaatgctcattggaaaatgactaggggtgctggcatctctctgtctttttccagatgggaaacgtttccctcaaggcaaaaatgccccctaagatgtattctggagaattcggcccagtcagagtgtatgtatcttttcccctgtcagacttgaagcaaattaaaatagacctaggtaaattctcagataaccgtgatggctatattgatgttttacaagggttaggacaatcctttgatctgacatggagagatataatgttactgctaaatcagacactaaccccaaataagagaagtgccacaataactgcagcccgagagtttggcgatctctggtatctcagtcgggtcaatgataggatgaaaatagaggaaagagaacaattccccacaggccagcaggcagttcccagtgtagaccctcactgggacgcagaatcagaacatggatattagtgccacagacatttactaacttgcgtgccagaaggactaaggaaaactagggagcagcctataaatttttcagtgatgtctactataacacagggaaaggaagaaaatcctactgcctttctggagagactaagggaggcattgaggaagcatacctctctgtcacctgactctattgaaggccaactaatcttaaaagataagtttatcactcagccagctgcagacatcagaaaaaaaacttcaaaagtctgctttaggcccggagcaaaacttagaaaccctactgaacttggcaacctcggttttttataatagagatcaggaggagcaggcagaacaggacagatgagataagaaaaaggccaccgctttagtcatggccctccaagctgactttggaggctctggaacgtggaaagcctgggcaaatcgaatgcctaatagggcttgcttccagtgcagtctacaaggacactttaaagaagattgtcgaatagaaatgagctgcccccttgtccatgccccttatctcaagggaatcattggaaggcccactgccccaaggaatgaaggtcgtttgaatcagaagccactaacctgatgatccagcagcaggactgagggtgcccggggcaagtgcctgcccataccatcaccctcacagagctccaggtatgcttgaccattgagggccaggaggttaactgtctcctggacactggcatggccttctcaatcttactttcctgtcctatacaactgtcctccagatctgtcactagccaaggggtcctaggacagccagtcactagatacttctcccagccactaaggtgtgactggggaactttactcttttcacatgcttttctaattatgcctgaaagcaccactctcttgttacggagagacattctagcaaaagcaggggccattgtacacctgaacataggagaaggaacacccgtttgttgtcccctgcttgaggaaggaattaatcctgaagtctggacaacagaaggacaatatggatgagtaaagaatgcctgtcctgttcaagttaaactaaaggattccacctcctttccctaccaaaggcagtaccctcttagacccgaggcccaacaaggactccaaaagattgttaaggacctaaaagcccaaggcctactaaaaccgtgcaacagcccctgcaatactccaattttaggagtacagaaacccaacagacagtggagtttagtgcaagatctcaggattatcagtgaggccgttgtctctctatacccactgtacctaacccttatactctgctttcccaaataccagaggaagcagagtggtttacagtcttggaccttaaggatgcctttttctgcatccctgtacatcctgactctcaattcttgtttgcttttgaagatccttcgaacccaacatctcaactcacctggactgttttaccccaagggttcaaggatagcccccatctatttggccaggcattagcccaagacttgagccagttttcatacctgaacactctcatcttttggtacatggatgatttacttttagccacccgttcagaaaccttgtgccatcaagccacccaagcactcttaaatttccttgccacctgtggctacaaggcttccaaacaaaaggctcagctctgctcacagcagaaatacttagggctaaaattatccaaaggcaccagggccctcagtgaggaatgtatccagcctatactggcttatcctcatcccaaaaccctaaagcaactaagagggttccttggcataacagccttttgctgaatatggattcccaggtacggcgaaatagccaggccattatatgcactcattaaggaaactcagaaagccaatatccatttagtaagatgtacacctgaagcagaagcagctttccaggccctaaagaaggccctaacccaagccccagtgttaagcttgccaacagggcaagacttttctttatatgtcacagaaaaaaacaggaatagctctaggagtctttacacaggtccaagggaacagcttgcaacctgtggcatacctgagtaaggaaattgatttagtggcaaagggttggcctcattgtttacaggtagtggcagcagtagcagtcttagtatctgaagcaggtaaaataatacagggaagagatatgactgtgtggacatctaatgatgtaaacagcatactcactgctaaagaagacttgtggctgtcagacaactgtttgcttaaatatcaggctgtattacttgaagggccagtgctgagaacttctctcttgtgcaactcttaacccagccacacttcttccagacaatgaagaaaagatagaacataactgtcaacaggtgattgctcaaacatacgccactcaaggggaccttctagaggttcccttgactgatcccgacctcaacttgtatactgatggaaattcctttgtagaaaaaggactttgaaaagtggggtatgcagtggtcagtgataatggaatacttgaaagtaatcccctcactccaggaactagcgctcggctggcagaactaatagccctcactggggcaccagaattagaaggaaaaaggggaaatatgtatacagactctaatatgcttacctactcctccatgcccacacagcaatatggagagaaagggaattcctaacttctgagggaacacctatcaaacatcaggaagccattaggagattattattcactgtacagaaacctaaagatgtggcagtcttacactgccggggtcatcagaaaggaaagtaaagggaaatggaagagaaccaccaagcggatattgaagcccatcaacagccacaaggcaggaccctccattagaaatgcttatagaaggaccctagtatggggtaatcccctctgggaaactaagctccagtactcagcaggagaaatagaatggggaacctcacaaggacatagtttcctcccctcaggatggctagccaccgaagaaggaataacacttttgccggcagcgaaccaatggaaattgcttaaaacccttcaccagacctttcacttaggcattgatagcacccaccagatggccaaattattatttactggaccaggccttttcaaaactatcaagcagatagtcagggcctgtgaagtgtgccaaagaaataaccccctgcactgccggccatacatttcaatccctgtatctttaacctccctgttaagtttgtttcttccagaatcgaagctgtaaaactacaaatcattcttcaaatggaaccccagatgcagtccatgactaagatctactgcggacccctggaccggcttgctagcccatgctccaatgttgatgacattgaaggcccccctcctgaggaaatctcaactgcacgatccctactatgccccaattcagcaggaagcagagcagtcgtcggccaacctccccaacagcactggggttttcctgttgagaggggggactgagagacaggactagctggatttcctaggccgactaagaatccctaagcctagctgggagggtgccgcatccacctttaaacacggggcctgcaacttagctcacacccaaccaatcaggtagcaaagagcgctcactaaaatgctaattaggcaaaacaggaggtaaagaaatagccaatcatctatcacctgagagacaatgattgggatataaacccaggcatttgagccagcaatggcaaccccctttgggtccccttccattgtgtgggagctctgttttcactctattacatcttgcaactgaacattcttctggtccgtgtttgtaacagcttgagctgagctttctctcactgtccaccactgctgtttgtcgccattgcagacccgccactgacttccgcccctctggatccggcagggtgttggctgcactcctgatccagtgactcacccattgctgctcctgatcgggctaaaggcttgccattgttcctgcatggctgagtgcctgggttcttcctaatctagctgaacactagtcgctgggttctatggttctcttttgtgacccacagcttctaataaagctataacactctctgcatggcccaagattccattccttggaatccatgaggccaagaaccccaggttagagaacaagaggctggctgccatcttggaagcggcctgccaccatcttgggagctctaagaacaaggacccccaggtaacat

SEQ ID NO: 222 - DNA, 5621 bp, Homo sapiens
gtcaggcctctgagcccaagctaagccatcatatcccctgtgacctgcacgtacacatccagatggccagttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgcctgccagagaacaacctccctttttcctttacctacccaaatcctataaaatggccccacccctatctcccttcactgactcagcctgcctgaacccaggtgaaataaacagctttattgctcacacaaagcctgtttggtggtctcttcacatggacgcaagtgaaatttggtgctgtaactcggatcgggggacctcccttaggagatcaatcccctgtcctgctctttgctccgtgagaaagatccacctacgttcaggtcctcagaccgacgaccccaagaaacatctcaacaatttcaaatccggtaagcagcctgtttttagtctcttctccaacctccctcactatccctcaacctctttctcctttcaatcttggtgccacacttcaatctctcccttctcttcatttcaattcttttcattttctggtagagacaaaggagacacgttttatccgtggacccaaaactcctgcaccggtcacagactagggaaggcagccttcccttggtgtttaatcattgcagggacgcctttctgattgttcacccaggtttcagaggtgtcagaccacacagggacacctgccttggtccttcacccttaatggtaagtcctgcttttctgggggaaaggcaagaaacctaaccccttctctccatgtctctaccccttctctgcttttctgggggaggagcaagaacccctcaaccccttctccttcacccttagcggcaagtcctgcttttctgggggagggacaggaactctgacctcttatctctgtgccccgatcccttatttccaccccccaacctcttatctctgtgccccgatccctgatttctgtgccccgacctcttatctctgcaccccaaccccttatttccgtgcctcgaccccttctctgcttttctggagggcaagaaccccccaccccttctccgtgtctctactgtctttcctctgggcttgcctccttcactatgggcaagcttccaccttccattcctccttcttctcccttagcctgtgttcttaagaacttaaaacctcttcaactctcacctgacctaaaatctaagtgtcttattttcttctgcaatgccacttgaccccaatacaaactcgacagtagtttcaaatagctggaaaacggcactttcaatttttccatcctacaagatctaaataattcttgtcgtaaaataggcaaatggtctgagatgcctgacatccaggcattcttttatacatcggtccctctctagtctctgttcccaatgcaacccctcccaaatcttccttctttccctcccacctgtcccctcagtcccaaccccaagcattgctgagtctttctaatcttccttttctacagacccatctgacctctcccctcctcaccaggccaagctaggtcccaattcttcctcagcctccgctcctccactctataatccttttatcacctcttctcacacccagtctggcttacagtttcgttccgtgactagccctcccccacctgcccagcaatttactcttaaaaaggtggctgaagctaaaggcatagtcaaggttaatgctcctttttctttatctcaaatcagatagcatttaggctctttttcatcaaatataaaaatccagcccagttcatggctcatttggcaacaaccctgagacgctttgcagccctagaccctaaaaggtcaaaaggccgtcttattctcaatatacattttattacccaatctgctcccaacattaaataaaactcgaaaaattaaattccagccctgaaaccccacaataggacttaattaacctcaccttcaaggtgtacaataatagagtaaaggcagccaagtagcaacatatttctgagttgcaattccttgcctccactgtgagacaaaccccagccacatctccagcacacaagaacttccgaacgcctaaactgcagtggccaggcattcctccagaaccgcctcccccaggagcttgctacaagtgccagaaatctggccaccatgccaaggaatgcccacagcccaggattcttcctaagccatgtcccatctgtgcgggaccccactggaaataggactgttcaactcacctggcagccactcccagagcccctggaactctggcccaaagctctctgactgactccttcccagatcttctcggcttagcggctgaagactgatgctgcccgatcacctcggaagccccgtagatcatcacagacaccgagctttaggtaactctcacagtggagggtaagtccgtccccttcttaatcagtatggaggctacccactccacattaccttcttttcaagggcctgtttcccttgcttccataactgttgtgcgtattgacagccaggcttctaaacctcttaaaactccccaactctggtgccaacttagacaatactcttttaagcactcctttttaattatccccacctgcccagttcccttattaggccgagacactttaactaaattatctgcttccctgactattcctggactacagctgcatctcattgctgcccttcttcccaatccaaagcctcctttgcgtccttctcttatatcccccaaccttaacccacaagtataagatacctctactccctccttggcgaccaatcatgcaccccttaccatctcattaaaacctaatcacccttatcctgctcaatgccaatatcccatcccacagcatgctttgaaaggattaaagcctcttatcttttgcctgctacagcatggccttttaaagcttataaactctccttacaattcccccattttacctgtcctaaaaccagatgagccttacaagttagttcaggatctgtgccttatcaaccaaattgttttgcctatccaccccatggtgccaaacccatatactctcctatcctcaatacctccctccacaatccattattctgtctggatctcaaacatgctttctttactattcctttgcaccgttcatcccagcctctctttgctttcacttggactgaccctaacacccatcaggctcagcaaattacctgggctgtactgctgcaaaggttcacagacagcccccattacttaagtgaagcccaaatttcttccttatctgttacctatctcagcataattctcataaaaacacacgtgctctccctgccggtcgtgtccgactaatctctcaaaccccaaccccttctacaaaacaactcctttcctttctgggcatggttggatactttcgcctttggatacctggttttgccatcctaacaaaaccattatataaactcacaaaaggaaacctagctgaccccatagatcctaaatcttttccccattcctctttccattccttgaagacagctttggaggctgcccccaccccagctctccctgactcatcccaacccttttcattacacacagctgaagtgcagggctgtgcagtcagaattcttacacaaggaccgggatcgcgtcctttttgtccaaacaacttgaccttactgttttaggctggccatcatgtctctgtgcagcagctgctgccaccctaatacttttagaggcccttaaaatcacaaactatgctcaactcactctctacagctctcataatttccaaaattgattttcttcctcacacctgacacatatactttctgcttcccagctccttcagctgtactcactctttgttgagtctcccacaattaccattgttcctgacccggacttcaatccggcctcccacattattcctgatatcacacctgaccctcatgactgcatctctctgatccacctgacgttcatctcatttccccgcatttccttcttccctgtttctcaccctgatcacgcttggtttattgatggcagttccaccaggcctaatcaccacacaccagcaaaggcagctatgctatagtacaagccactagcctgcctcttagaacctctcatttcctttccatcatggaaatctatcctcaaggaaataaattctcagtgttccatctgctattctactactcctcagggattattcaggccccctcccttccctacacatcaagctcagggatttgcccccgcccaggactggcaaatttgctattctactacttctcaaggattattcaggccccctcccttccctacacatcatgctcagggatttgcccctacccaggactagcaaattagctttactcaacatgccctgagtcaggaaactaaaatatctcttggtctaggtagacactttcactggataggtagaggcctttcccacagggtctaagaaggccaccatggtcatttcttcccttctgtcagacataattcctcggtttggccttcccacctctatacagtccaatagcagaccggcctttattagtcaaatcagccaagcattttttcaggctcttagtattcagtgaaacctttatatcccttacagtcctcagtcttcaggaaagatagaacagactaatggtcttttaaaaacacacctcaccaagctcagccaccaacttaaaaaggactggacaatacttttaccactttcccttctcagaattcaggcctgtctttggaatgctacaaggtacagcccctttaagctcctgtatagacgctcctttttattaggccccagtctcattccagacaccagaccaacttagactgtgccccaaaaaacttgtcatccctactatcttctgtctagtcatactcctattcactgttctcaactactcatgcatgccctgctcttgtttacactgccagttttcactgtttctccaagccatcacagctgatatctcctggtgctatccccaaaccgccactcttaactcttaaagtaaataaataatctttgctggcaggactatgctgaacctccttacgcactctctaatcagatagcccaggtcctcccaattcttagtcctttagtacctgtttttctccttctcttattccatttagtttttcaattcatacaaaactgtatccaggcctcaccaataattctaaatgacaattgtttcttctaacaaccccacaatatcaccccttaccacaaaatcttccttcagcttaatctctcccactctatgttcccacgctgcccctaatcccactcgaagcagccctgagaaacatcgcccattctctctccataccaccccccaaaaattttcacctccccaacactttaccactatttcattttatttttcttattaatataagaagacaggaatgtcaggcctctgagcccaagctaagtcatcatatcccctgtgacctgcactca

SEQ ID NO: 223 - DNA, 966 bp, Homo sapiens
gtggggaaaagaaagagagatcagattgttactgtgtctgtgtagaaagtagaaatacgagactccattttgttctgtactaagaaaaattcttctgccttgagatgctgttaatctgtaaccctacccccaaccctgtgctccctgagacatgtgctgtgtcaactcagggttaaatggattaagggctccgcagggtgtgctttgttaaacaaatgcttgaaggcagcatgctcgttaagagtcatcaccactccctaatctcaagtacccagagacacaaaacactgctgaagcccacagggacctctgcctgggaaagccaggtattgtccaaggtttctccccatgtgatagcctgagatatggcctcctgggaagggaaagacctgaccacccccccagcccaacacctgtaaagcgtctgtgctgaggaggattagtgaaagaggaaggcctctttgcaggtgagctaagaggaagtcatctgtctcctgcttgtccctgggcaatggaacgtcttggtgtcaagcccgattgtatattcctactactgagataagggaaaaccaccttagggctggaggtgggacatgctggcagcaatactgctctttaatggattaagatgtttatgtgtatgcacatcaaaagcacagcacttaattctttatctggtttaagatgtagagagctttgttcacgtgttttcctactgaccttctctccgctcttaccctattgtcctgccaaatccccctctctggaaacgcctgaaaattatcaataaatactaagggaactcagaggctgctgccggcatgggtcctccgtattctgaacgcccgtcccctgggcactattttctttctctatactttgtctctgtgtctctttcttttccaggtctctcattccacctaatgagaaacgcccacaggtgtggaggggcaacccaccccttca

SEQ ID NO: 224 - DNA, 3005 bp, Homo sapiens
gttaggcctctgagcccaagcttagccatcatatcccctgtgacctgcatgtatacatccagatggcctgaagcaagtgaagaatcacaaaagaagtgaaaatggccagttcctgccttaactgatgacttcccaccattgtgatttgttcctgccccaccttaactgagcgattaagcttgtgagattccttctcctggctcagaaccttccccactgagcgccttgtgatcccccccaccacccacctgcaagagaaaaaccccttttgactgtaattttccactatgcacccaaatcctataaaacagccccacccctatctccctttgctgactctctttgcgaactcagcccacctgcacccaggtgattaaaaagctttatttatcacacaaagcctgtttggtggtctcttcacacggacgcacatgaaatttggtgctgtgacttagatcaggggacctcccttgggagatcaatcccctgtcctcctgctctttgctccatgagaaagatccacctacaaccttgggtcctcagaccaaccagcccaaggaacatctcaccaattttaaatcaggtaagcggtctctttttactctcttctccaacctctctcactatccctcaacctctttctcctttcaatcttggcaccacccttcaatctctcccttctcttaatttcagtttctttccttttcactagagacagatgagactcattttatccgtgaacccaaaactccggcaccagtcatggactcaggaagacagtcttcgcttggtgtttaatcactgcggagacacctggttgattattcactcacatttcagaggtgtctgatcaccgtgggggcgcctgccttgatccttcacctcagtggcaagtaccacttacctggggggcaagcacccctcaccccttctctccatgtctctaccctctcttttctctgggcttgcctccttcactatggacaaccttccaccatccattcctccctcttctcccttagcctgtgttctcaagaacttaaaacctcttcaactcacacctgacctaaaacctttctccttatatcatctcaactccccccatatttggacctctcacaatgcaaactactattcctgtggccactcctttatgtatctcttggcaaagacccactagaatccccctgggtaacctttcaccttctcgatgttccttcactcttcatctccaaagcccaactacacacatcactgaaacaattggagccttccagctccgtattacagataagccctctgtcaatactggcaaacttaaaaacattagcagttattattgcttaggaagacacttaccctgtatttcactccatcattggctaccttccccttactcgtcagactctcctcccaggccctcttgttgtttatttgtacccagctccataaataacagtgaaaggttgctcataaacactcaatgttttcttatgcaccatgaaaatcaaacctccccctctacgcagttacctcatcagtccccattacaacctctgatggctgctgccctagctggatccctagaagtctgggcacaagacacatcttttagtactccttctcatctttttactttgcatttccagttttgccttgcacaaggtctcttcttcctctgtggatcctctacctacatgtggctacctgctaattggacaggcacatgcacactagttttccttactcccaaagttcaatttgcaaatgggactgaatagcttcctgttcccctcatgacactgacatgacacaagagagttattccactgattcccttgcttgtcggtttaggactttctccctccactattgctctcagtactggaatagcaggcatttcatcctctgtcacgacctttcgtagcctctctaatgacttctctgctagcatcacagacatatcacaaactctatcagtccttcaggcccaagttgactctcttgctgcatttggcctctaaaaccaccgaggccttgacttactcactgctgaaaaaggaggactctgtatatttttaaatgaagagtgttgtttttacctaaatcaatctggcctggtgtaagacaacataaaaaaactcaaggatagagcccaaaaactcatcaaccaaggaagtaattatgctgaacccccttgggcactctctaattggatgccatggatcctcccaattcttagtcctttaatacctgtttttctccttctcttatttggaccttgtgtcttccatttagtttttcaattcatccaaaaccatatccaggccatcaccaatcattctatacgacaaatgctccttctaacaaccccacaatatcaccccttaccgcaaaatcttccttcagctgaatctctcccactctaggttcccatgccacccctaatcccacttgaagcagccctgaaaaacatcacccattatctctccataccacccccaaaaatgttcactgccccaacacttcaatactattttatggggtttttttattgatataagaagacaggaatgtcaggcctctgagcccaaactaagccatcatatcccctgtgacctgcatgtatacatccagatggcctgaagcaagtgaagaatcacaaaagaagtgaaaatggccagttcctgcctcaactgatgacatcccaccattgtgatttgttcctgccccaccttaactgagcaattaaccttgtgagattccttctcctggctcagaacctcccccactgagcagcttgtgatccccgcctctgcctgcaagagaaaaaccccctttgactgtaattttccactacccacccaaatcctataaaatggccccaccccatctctcttcactgactttctttttggactcaacctgcctgtacccaggtgattaaaaagctttattgctcacacaaagcctgtttggtggtctcttcacacggacatgcatga

SEQ ID NO: 225 - DNA, 668 bp, Homo sapiens
ttacagtaggtagtaacaaggcttgagcggggcaggagggagctctccctgctctccaccaggaatgtcgggccaccatcaggtgatgggcaggtggttgttaactgcctctctaaaataataactggtcacagccagcgccaggaaaaggcagtctcccaatagatagaaaaaaaacctgaaactggtgatgcaatcagcaggagttcagggagtggactcaagcatgagctttaagaagcaaaatggcagagtttacttgttatatgaccttctaggttcattcgatttgtaagggaagaatgcctcacctgagcacgcatacaagtccagtaaacacactgcacttgctcacctcccaagtgccagcagcccactgcacatgcagacagcccaccccaaggcaagaatcaggggagaagagatgcaagaccctagaaatatgccaaccccaagtcagaaggtcaaatagggcacttgatctctcaagtcacccgcttggccttcttccaagtgtattttatttcctttcattccttcgctaaagcttttatgataaacttttactcatgctctattgcctccatctctcctgcgttctgcctccttggttgaattctttctttggaggaggcaagaactgaggttgctgcagacccatacggatt

SEQ ID NO: 226 - DNA, 4871 bp, Homo sapiens
gtcaggcctctgagcccaagctaagccatcatatcccctgtgacctgcacgtatacatccagatggcctgaagcaactgaagatccacaaaagaagtgaaaataaccttaactgatgatactccaccactgtgatttgtttctgccccaccttaactgatcaacgtgctttgtaatcgcccccacccttaagaaggttctttgtatttctccccacccttgagaatgtactttgttagatccaccccctgccacaaaacaccactcctaactccaccgcctatcccaaaacctgtaagaactaatgataatcccaccaccttttgctgactctctttttggactcagcccgcctgcacccaggtgaaataaacagccttcttgctcacacaaagtttgtttggtggtctcttcacactgacgcgtgagacatttggtgctgaagacccgggtcagagggactccttcggaagaccagtcccctgtcctcgcctcactccatgaggagatccacctacaacctcgggtcctcagaccaaccagcccaaggaacatctcaccaatttcaaatcgggtaagcggtcttttcactctcttctccagcctctctcgctacccttcaatctccctgcccttccaattccagttctttttcctctctagtagagacaaaggagacacattttatccatggacccaaaactctggcgccagtcacagactcgggaagacagccttcccttggtgtttaatcattgcagagacgcctgcctgattattcacccacaattcactggtgtctgatcactgcagggacgcctgccttggtcattcacccacattcccatggtggcaagtcaattgcggggatgcctgctttggctcctcacccacactgcagcccagggctgctccccaccaccccgcttctccgtgtctctacctttctctttaaacttaccttcttcactatgggcaaccttccaccctccattcccccttcttctcccttagcctgtgttctcaagaacttaaaaccccttcaactcacacctgacctaaaacctaaatgccttattttcttctgcaataccgcttgaccccaatacaaactcgataatggttctaaatagccagaaaatccattttacaagatctagataatttttgtcgaaaaatgggcaaatggtctgaggtgcctgacatccaggcattcttttacacattggtccctccctagtctctgctcccaatgcgactcatcccaaatctttcttctttctctcctgtctgttccttcagtctccacaccaagctctgagtcctttgaatcctccttttctacagacccatatgacctctcctccccaggctgctcctcaacaggctgagccaggtcccaattcttcctcagcctctgctccccgaccctataatctttttatcaactcccctcacacccattctggcttacagtttcattccgcgactagccctcccccacctgcccaacaatttcctcttaaaaaggtgactggagctgaaggcatagtcaaggttaatgttcctttttctttatccgacctctcccaaatcagttagcgtttaggctctttttcatcaaatataaaaacgcagcccagtccatggcccgtttggcaacaaccctttgacgttttactgccctagacccacaggggccagaaggctgtcttattctcaatatacattttattaaccagcccactcccaacattaaaaaaagctccagaaattagattctggccctcaaaccccacaagaggacttaattaacctcgccttcaaggtgtacaataatagagtagaggcagccaagtagcaatgtatttctaagttccagttccttgcctccactgtgagacaaaccccagctacattgccagcacacaagaactccaaacacctgaagtgcagctgccaggggttcctccagaacctcttccccaggagcttgcttcaagtgccagaaatctggccactgagccaaggaatgccctgcagcccgggattcctccttagccgtgtcccatttgtacaggaccctactggatatcagactgtccaactcgcccggcagccactcccagagcccctggaactctggcccaaggctctctgactgacttcttcccagatcttctcagcttagtggctgaagaccgacgctgcccgatcgcctcagaagcttcctggaccatcacagacgctctgggtaactcttacagtggagggtaagtccgtctccttctaaattaatatggaggctacccactccacattaccttattttcaacgacctgtttcccttgcccccataactgttgtgggtattgatggccaggcttctaaacctcttaaaactccccaactctgatgccagcttggacaacattcttttatgcactcctttttagttatccccacctgcccagctcccttattagatcaagacattttaactaaattatctgcttccctgactattcctaagctacagccacacctcattgccacccttcttcccaacccaaagcctccttcacatcttcctcttgtatccctccaccttaacgcacaggtacgggacacctctactccctccctagcaaccgatcacatgccccttaccatcccattaaaacctaatcacccttaccccgctcaatgccaatatcccatcccacagcacgatttaaaaggattaaagcctgttatcacttgcctgttacagcatggccttttaaagcctataaactctccttacaattcccccattttaccttgtcaaaaacctgacaagtcttataggttagttcaggatctgtgccttagcaaccaaattgtcttgcctagccaccctgtggtgccaaacccatatactctatcctcaatacctccctccacaacccattattctgtcctagcaaacctagctgaccccatagatcctaattcctttcgccactcctctttccattccttaaaaacagccctagaagctgccaccacgctagctctccctaactcatcccaacccttttcattacacacagccaaagtactgggctctgcggtcaaaattcttacacaagagccggaaccgtgccctgtagcctttctgtccaaacaacttgaccttactattttaggctggccatcatgtctccgtgcagaggctgccgccgctctaatacttttagaggccctaaaaatcacaaactatgctcaactcactctctacagttctcataacttccaaaatctattttcttcctcccacctgatgcatatactttctgctccccggctccttcagctatactcactctttgggtctcccacaattaccactgtttctggcctggacttcaatctggcctcccacattattctggataccacacctgacccccatgactgtatctctctgatccacttgacattcactccatttccccatatttccttctttcctcttccccatcctgatcacactcagtttattgatggcagttccaccaggcctaatcgccactcaccaacaaaggcaggctatgctatagtatcttccacatctatcattgaggctaccgctctgcccctctccactacctctcagcaaggcgaactcatgccttaacctgagccctcactcttgcaaaaggactacgcatcaatatctatactgactcgaaatatgccttccatatcctgcaccaccgtgctgttatatgggctgaaagaggtttcctcaccgtgcaagggtcctccatcattaattcctctttaataaaaactcttctcaaggccgctttacttccaaaggaagctggagtcattcactgcaagcaagggccatcaaaaggtgtcagatctcatcgttcagggcaacgcttatgctgataaggtagctaaacaagcagctagcgttccaacttctgcccctcatggccagtttttctccttctcgtcagtcactcccacctactctgccactaaaacttccacctatcaatgtcttcctacacaaggcaaatggttcttggaccaaggaaaatatctccttccagcctcacaggcccattctattctgtcgtcatttcataacctcttccatgtaggttacaagccgctagcccatctcttaaaacctctcatttcctttccatcgtgaaaatctatccccaatccaccactcttgcctccctcttggagtggatagatgatctttgctgacagaacacactccaatactttcaccctgatgaagtcttattctttacttttatactcattcttattcttgttcccgttcttatgccacccactacctctccccagctatctctatcacactatcaatcgcactcactctctcctagccatttctaatccttctttaacaaacaattgctggctttgcatttcttttttctccaaaatcaccgaggccctgacttactcactgctaaaaaaaggggactccgtatatttttaaataaagagtgttgtttttctgtaaatcaatctggcctggtatatgacaacataataaaactcaaggatagagcccaaaaattcgccaaccaagcaagtaattatgctgaacccccttaggcactctctaattggatgtcctgggtcctcccaactctcagtcctttaatacctgtttttctccttcttttattcagaccttctaacttctgtttagtttctcaattcatacaaaactgtatccaggccatcaccaatcattctatatgacaaatgtttcttctaacaaccccacaatatcaccccttaccacaaaatcttccttcaacttaa

SEQ ID NO: 227 - DNA, 406 bp, Homo sapiens
gtcaggcctctgagcccaagctaagccatcatatccccctgtgacctgtaggtatacatccagatggcctgaagtaactgaagaatcacacaagaagtgaaatttaaatggcctgttcctgccttaactgatgacattaccttgtgaaattccttctcctggctcatcctggctcaaaagctcccccactgagcaccttgtgtcccccgcccctaccggccagagaacaaccccctttgactgtaattttcctttacctacccaaatcctataaaacagtcccacccctatctcccttcgttgactctctttttggactcagcccgcctgcacccaggtgaaatgaacagccttgttgctcacacgaagtctgtttggtgatctcttcacacggacgcgagtgaaa

SEQ ID NO: 228 - DNA, 665 bp, Homo sapiens
tagactggtaagggaagaatgtctcaaatgagcatgcgtacaattccagtaaacacactgagcgtgcggcccctcccaaattctggcaggccactgcacatgcggacagcccagcccaagggcagaatcaggggagaaggaatgcaagaccctcagaagtatgccagcgtataaaatcccaagtcagaaggtcaaaccgaacacttgatctctgaagtcgcccgcttggccctcttccaagtgtacttcctttcatttctgctctaaattttttattttttatttttttatttttttttagacggagtctctctctgtcgcccaggctggagtgcagtggtgtgatctcagctggctgcaacctccacctcctgggttcaggcgattctcatgcctcagcctcccgagtagctgggactacaggtgcctgccaccacacctggctaatttttgtatttttagtagagacagggtttcgccatgttggccaggctggtctcgaactcctgacctcatgtgatctgcctgcctcggccccctaaagtgttgagattacaggcgtgaaccaccatgcccggcgtgctctaaaacttgtctcagcctttccttctgccttatgccccttagttgaattcttccttctgaggaggcaagaattgaggttg

SEQ ID NO: 229 - DNA, 398 bp, Homo sapiens
gtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaa

SEQ ID NO: 230 - DNA, 5880 bp, Homo sapiens
gtcaggcctctgagcccaagccaagccatcacatcccctgtgacttgcacgtatacgcccagatggcctgaagaaactgaagaatcacaaaagaagtgagtatgccctggcccaccttaattgatgacattccaccacaaaagaagtgtaaatggccagtccttgccttaagtgatgacattaccttgtgaaagtccttttcctggctcatcctggctcaaaaagcacccccactgagcaccttgcgacccctactcctgcccgcgagagaacaaaccccctttgactgtaattttcctttacccacccaaatcctataaaacagccccacccttatctccctttcgctgactctcttattttcacctgcctgcacccaggtgaaataaatagccatgttgctcacacaaagcctgtttggtggtctcttcacacagacgtgcatgaaatttggcgccgtgactcggattgggggaactcccctgggagatcaatcccctgtcctcttgttctttgctccatgagaaagatccacctacgacctcaggtcctcagactgaccagcccaaggaacatctcaccaattttaaatcaggtaggtggcctcttcttactctcttctccaacctctctcactgtccctcaaccactttcttctttccactcttcaatctctcccttctcttaatttcaattcctttcattttctgggagagacaaaggagacacgttttatctgtggacccaaaactccggcgccagtcacagactgggaaggcaggcttcccttggtgtttaatcattgcagggatgcctctctgattattcacccacgtttcaaaggtgtcagaccacgcagggacgcctgccttggtccttcacgcttagcagcaagtcccgcttttctggggaagaggcaagtaccccaaccccttctctccttgtctctaccccttctctcctttcctggggcaggggcaagtacccctcaaccccttctccttcacccttagtggcaagtcctgcttttctgggtgaggggcaagtacccctcaaccccttctccttcacccttagtggcaagtcccgcttttctgggggaggggcaagtacccctcaaccccttctctttcacccttagcggcaagtcccgcttttctagggggcaagaacccccaatcccttatttccgcaccccaacctcgtatctctgtgccccaatcccttatttccatgccctgaccccttatttccatgccccaaccccttatttccatgccctgacctcttatctctgtgccctaaccccttttcccacttttctggaagggaagaacccccaaaccccttccctccatttctctactctcttctctaggcttgcttccttcactataggcaaccttccaccctccattcctccttctactcccttggcctgtgttctcaaaaacttaaaatctcttcaactcacaactgacctaaaacctaaatgccttattttcttctgcaatgccacttgaccccaatacaaactcgactgtagttccaaatagccagaaaatggcactttgaatttttccatcctgcaagatctaaataattcttgtcctaaaataggcaaacagtctgaggtgcctgacgtccaggcattcttttacacatcagtcccttccttgtctctgtgcccagtgcaaatcatcccaaatcttccttctttccctcccgcctgtcccctaagtcccaaacccaagcatcgatgagtctttctaatcttccttttctacagacccatctgacctctcccctccttgccaggcctagctaggtcccaatgcttcctcagcctccgctcctccaccctataatctttttatcgcctcccctcctcacacctggtctggcttacagtttcgttcttgactagccctcccccacctgcccagcaatttactcttaaaaaggtggctggagccaaaggcatagtcaaggttaatgctcctttttctttatcccaaatcggatagcgtttaggctctttttcatcaaatataaaaatccagcccagttcatgacttgtttggcagcaaccctgagacactttacagccctagaccctaaaaagtcaaaaggccgtcttattctcaaaatacattttattacccaatctgctcccgacattaaataaaactccaaaaattaaattctggccctcaaaccccacaacaggatttaattaacctcaccttcaaggtgtacaatgatagaaaaaagttgcaattccttgcctccactgtgagacaaaccccagccacatctccagcacacaagaacttccaaacacctgaaccgcagcggccaggcattcctctagaacctcctcccacaggagcttgctacatgtgccggaaatctggcctctgggccaaggaatgcccgcagcccgggattcctcctaagccacgtcccatctctgtgggaccccactgaaaatcggactgttcaactcacctggcagccactcccagagcccctggaactctggcccaaggctctctgactgactccttcccagatcttctcggcttagcagctgaagactgacactgcccgatcgccttggaagccccctagaccatcacggacgccaagcttcaggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcattgccgcccttcttcccaatccaaagcctcctttgcatcctcctcttgtatccaccccccttaacccacaagtataagatacctctactccctccttggcgaccgatcatgcaccccttaccatctcattaaaacctaatcacccttaccccactcaatgccaatatcccatcccgcagcatgctttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccaccccgtggtgccaaacccatatactctcctatcctcaatacctgcctctataacccattattctcttctagatctcaaacatgctttctttactattcctttgcacccttaataccagcctctcttcactttcacttggactgaccctgacacccatcaagctcagcaaattacctaggctgtactgctgcaaagcttcacagacagcccccattacttcaatcaagcccaaatttcttcctcatctgttacctatctcggcataattctcataaatcacacgtgctctccctgccaatcgtgtccgactgatctctcaaaccccagcaccttctacaaaacaacaactcctttccttcctaggcatggttagcatggtctgaattcttacacaggagccaggaccacaccctttagcctttctgtccaaacaacttgaccttactgttttagcctagccctcatgtctgcgtgcagtggctgctgctgctttaatacttttagaggccctaaaaatcacaaactatgttcaactcactctctatagttctcataacttccaaaatctatttgcttcctcatacctgatgcatatactttctgcttcctggctccttcagctatactcactctttgttgagtctcccacaattaccgttgttcctggcccagacttcaatccggtctcccacattattcctgataccacacctgacccccatgactgtatctctctgatccacctgacattcaccccatttccccaaatttccttctttcctgttcctcaccctgatcacgcttgatttagtgatggcgattccaccaggcctaatcgacacacaccagcaaaggcaggttatgctatagaacaagccactagcccgcctctcagaacctctcatttcctttccatcgtggaaatctatcctcaaggaaataacttctcagtgttccatctgctattctactactcctcagggattattcaggccccctcccttccctacacatcaagctcgaggatttgccccacccaggactggcaaattagctttactcaacatgccctgagtcggataactaaaatacctcttagtctagttagatactttcactggataggtagaggcctttcctacagggtctgagaaggccaccacagtcatttcttcccttctgtcagacataattcctcagtttagccttcccacctcaatacagtctgataacagacgagcctttattagtcaaatcagccaagcagtttttcaggctcttagtattcagtgaaacctttatatcccttacggtcctctgtcttcaagaaaagtagaatggactaaaggtcttttaaaaacacacctcaccaagctcagccaccaacttaaaaaggactggacaatacttttaccactttcccttctcagaattcaggcccgtccttggaatgctgcagggtacagcccatttgagctcctgtatagacgctcctttttattaggccccagtctcattctagacaccagaccaagttagactgtgccccaaaaaaacttgtcatccctactatcttctgtctagtcatactcctattcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctctttaggcactgtctaatcagatgtcctgagtcgtcccaattcttcgatcttttatacctgtttttctccttctgttattccatttagtttctcaattcatccaaaaccgtatccaggccatcaccaatcattctataagacaaatgtttcttctaacatccccacaatatcaccccttaccacaagacctcccttcagcttaatctctcccactctaggttcccacgccgcccctaatcccacttgaagcagccctgagaaacatcgcccattctctctccgtaccaccccccaaaaattttcaccgccccaacacttcaacaccattttgttttatttttcttattaatataagaaggcaggaatgtcaggcctctgagcccaagccaagccatcacatcccctgtgacttgcacgtatacacccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaagcacccccacagagcactttgtgacccccactcctgcccgccagagaataaaccctctttgactgtaattttcctttacctacccgaatcctatgaaatggctccacccttatctcccttcgctgactctcttcggactcagcccacctgcacccaggtgaaataaacagccatgttgctcacacaaagcctgtttggtggtctcttcacacggacatgcatgaaa

SEQ ID NO: 231 - DNA, 714 bp, Homo sapiens
ttacagtaggtagctaatcagacgtgaacagggcaggagaggcatcaaccacaacaacccccaccaccccaatcaggaatgtcaggtgaccatcagttgatggtcaggcagtttttaactgtctctctaaaataataactggttgcagctggtgcaaggggtgagtcagtctcccaataggtaggaaaaacctgaaactggtgatcagtggcttccggataagaagatctcagggctcacacatgtgcactaagaggcaaaatggtggagtttaattggtatctgacctctaaggacattcggctggtaagggaagaatgcctcaagtgagtatgcgtacaactccggtaaacacactgcgcatgttctcctcccaagcactgacaggccactgcgcaggcagacagcccaccccaaggaaagaataaggggagaaggaacacaagatccggaagtatgccaacgtagaaaaccccaagtcaaaaggtcaaacagcacatttgtctttcaagtcacccacttggccctctcccaagtgtactttccttccttttgttcctgctctaaagcattttaataaacttttactcctgctctaaaacttgcctcggcctctccttctgccttatgcccccctcagctgaattctttcttctgaggaggcaagaattgaggttgccgcaggcctgtatggatttgcagccgtaacaatac

SEQ ID NO: 232 - DNA, 2158 bp, Homo sapiens
tgcagtcagaattcttacacaagagccagaaccacaccctgtagcctttctgtccaaacaacttgaccttactgttttagcctagccatcatgtctccgtgcagcagctgctgccgccctaataattttagaggccctcaaaatcacaaactatgctcaacttactctctacatttctcataacttccaaaatctattttcttcctcatacctgatgcatatactttctgctccccggctccttcagctgtactcactctttgttaagtcccacaattaccattgttcctggcccggacttcaatccggcctcccacattattcctgataccacacctggcccctatgaatgtatctctctgatccacctgacattcaccccatttccccatattgccttccttcctgttcctcaccctgatcacacttgatttattgatggcggttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcaaggatttgcccccgcccaggactggcaaattagctttactcaacatgccccgagtcacaaaaactaaaatacctcttagtctaagtagacactttcactagataggtagaggcctttcccacagggtctgagaaggccaccgcagttatttcttcccttctgtcagatataattcctcagtttagccttcccacctctatacagtctgataacagatcagcctttattagtcaaatcagccaagcagtttttcatgctcttagtattcagtgaaacctttatatcccttacagtcctcagtcttcaggaaaagtagagcagactaaaggtcttttaaaaacacacctcgccaagctcagccacacacttaaaaaggaatagacaatacttttaccactttcccttctcagaagtcagacctgtcctcagaatgctacaaggtacagcccatttgagctcctgtatagacgttcctttttattaggccctagtctcattccagacaccagaccaacttagtctgtgccccaaaaaaacttgtcatccctactatcttctgtctagtcatactcctattcactgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaagcactctctaatcagatgtcctgagtcgtcccaattcttagaccttttatacctgtttttctccttctcttattccatttagtttttcaattcatacaaaactgtatccaggccatcaccaataattctaaattacaaatgttccttctaacaaccccacaatatcaccccttaccacaaaatcttccttcagcttaatctctcccactctagcttcccacaccgcccctaatcccgctcgaagcagccctgagaaacatcgcccattatctctccataccatcccccaaaattttcgctgtctcaacactttaccactatttcgttttatttttcttattaatataagaagacaggaatgtcaggcctctgagcccaagctgagccatcatatcccctgtgacctgcacgtacacatccagatcgctggttcctgccttaactgatgacattccaccacaaaagaagtgaaaatggcctgtttctgccttaactgatgacatcgtcttgtgaaattccttctcctggctcatcctggctcaaaagctcccccactgagtaccttgtgacccccactcctgcccgccagagaacaacccccctttttcctttacctacccaaatcctataaaacggccccacccctatctcccttcgctgactctcttttcggactcagcccacctgcacccaggtgaaataaacagctttattgctcacacaaagcctgtttggtggtctcttcacacagacgcgcgtgaaa

SEQ ID NO: 233 - DNA, 6351 bp, Homo sapiens
gtcaggcctctgagcccaagccaaatgaaatttggtgccatgactcggctcgggggacctcccttgggagatcaatcccctgtcctcctgttctttgctccgtgagaatgacccacctgtgacctcaggtcctcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccatggacccaactccggcaccggtcatggactgggaaggcagccttcccttggtgtttaatcattgcagggacacctctctgattatacactcacgtttcaagggtgtcagaccacacagggacacctgccttggtccttcacccttagcggcaagtcccgattttctgaggaagggacaagtacccctcaaccccttctctccttgtctctaccccttctctgcttttctggggcaggggcaagaacccctcaaccctttctccttcacccttagcggcaagtcccgctttcctggggcaggggcaagtacccctcaaccccttctccttcacccttagtggcaagtcctgctttcctagggggcaagaaccccccaatcgcttatttccataccctaacctcttatctctgtgccccaatcccttatttctgcaccctgacctcttatctctgtgccccaatcccttatttctgtgccccaacaccttctctgcttttctggagggcaagaaccctccaccccttctccgtgtctctactcttttctctgggcttgcctccttcactatgggtaagcttccaccttccattcctccttcttctcccttagcctgtgttctcaaaaacttaaaatctcttcaactcacacctgacctaaaacctaaatgccttttcttctgcaatgccacttgaccccaatacaaactcgacagtagttccaaatagccagaaaatggcactttgaattttttcatcctgcaaaatctaaataattcttgtcgtaaaataggcaaatggtctgaggtgcctgatgtccaggcattcttttacacatcaatcccttcctagtctctgtgcccagtgcaactcgtcccaaatcttccttctttctctcccacctatcccctcagtaccaaccccaagcatcactgattctttctaatcttccttttctacagacccatctgacctctctcttcctccccaggctgctcctcaccaggccgagctaggtcccaattcttcctcagcctccgctcctccaccctataatctttttatcacctcccctgtaggggtgggttgcccctccacacctgtgggtgtttctcataaggtggaacaagagacttaggaaagaaaaagacacaaagtatagagaaagaaataaggggacccggggaaccagcgttcagcatatggaggatccccccagcctctgagttcccttagtatttattcatcattcgtgggtgtttctccaagagggggatgtgtcagggtcacaagacaattgtggggagagggtcagccgacaaacacgtgaacaaaggtctttgcatcatagacaaggtaaaggattaagtgctgtgcttttagatatgcatacacataaacatctcaatgctttacaaagcagtattgctgcccgcatgtcccacctccagccctaaggtggtttttccctatctcagtagatggaacatacaatcgggttttataccgagacattccattgcccagggacgggcaggagacagatgccttcctcttgtctcaactgcaagaggcatgccttcctcttatactaatcctcctcagcacagaccctttacgggtgtcggggtgtcgggcggggggacagtcaggtctttcccttcccatgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtttgacacagcacatgtttcagagagcacggggttgggggtaaggtcacagaatctcaaggcagaagaatttttcttagtacataacaaaatggagtctcccatgtctatttctttctacacagacacagtgacaatctgatctctcttgcttttccccacatcccctcctcacacctggtccggcttacagtttcgttctgtcccccacctgcccagcaatttactcttaaaaaggtggctggagccaaaggcatagtcaaggttaatgctcctttttctttatcccaaatcggatagcgtttaggctctttttcatcaaatataaaaacccagcccagttcatgacttgtttggcagcaaccctgagacactttacagccctagaccctaaaaagtcaaaaggccgtcttattctcaaaatattttattacccaatctgctcccgacattaaataaaactccaaaaattaaattccggccctcaaaccccacaacaggatttaattaacctcgccttgaaggtgtacaataatagaaaaaaattgcaattccttgcctccactgtgagacaaaccccagccacatctccagcacacaagaacttccaaacacctgaaccacagtggccaggcgttcctccagaacctcctcccacaggagcttgctacacgtgccggaaatctggccactgggccaaggaatgcccgctgcccaggattcctcctaagctgcgtcccatctgtgtgggaccccactgaaaatcggactgttcgactcacctggcagccactcccagagcccctggaactctggcccaaggctctctgactgactccttcccagatcttctcagcttagcggctgaagactgacactgcccgaacgcctcggaagccccctagaccatcacggatgctgagcttccggtaactttcacagtggaaggtaaacccatccccttcttaatcaatacagaggctacccactccacattaccttcttttcaagggcctgtttcccttgcctccataactgttgcgggtattgatggccaggcttctaaacctcttaaaactccccaactctggtgccaacttagacaatactcttttaagtactcctttttagttatccccacctgcccagttcccttattaggctgagacactttaactaaattatctgcttccctgcctattcctggactacaactatatctcattgctgcccttcttcccaatccaaagcctcctttgcatcctcctcttgtatccccccaccttaactcacaaatataagatacctctactccctccttggtgaccgatcatgtaccccttaccatctcattaaaacctaatcacccttaccccactcaatgacaatatcccatcccgcagcaggctttaaaaagattaaagcctgttatcactcgcctgctacagcatggccttttaaagcctataaactcttcttacaattcccccattttacctgtcctaaaaccagataagacttacaatttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcatttctcataaaaacccacatgctctccctgccaatcgtgtccaactgatctctcaaacccaagcaccttctacaaaacaacaactactttccttcctaggtatggttagcatggtcagaattcttacacaagagccaggaccacaacttgtagcctttctgtccaaacaacttgaccttactgttttagcctagccctcatgtctgcgtgcagcagctgctgctgctttaatacttttagaggccctcaaaatcacaaactgtgctcaactctctctctacagttctcataacttccaaaatctattttcttcctcatacctgatgtatatactttctgcttcccggctccttcagctttactcactctttgttgcatctcccacaattaccattgttcctggcccagacttcaatccagcctcccacattattcctggtaccacacctgacccccatgactgtatctctctgatccacctgacattcacatttccccaaacttccttctttcctgttcctcaccctgatcacacttgatttattgatggcggttacaccaggcctaatcgccacacaccagcaaaggcaggtgatgctatagtacaagccactagcttgcctcttagaacctctcatttccttcccattgtggaaatctatcctcaaggaaataacttctcagtgttccatctgctattctactactcctcagggattattcaggccccctcccttccctacacatcaagctcgaggatttgccccacccaggactggcaaattagctttactcaacatgacctgagtcaggtaactaaaacacctcttagtctaggtagacactttcactggataggtacaggcctttcctacagggtctgagaaggccaccacagtcatttcttccattctgttagatataattcctcagtttagccttcccgcctctatacagtctgataacagatgagcctttattagtcaaatcagccaagcagtttttcaggctcttagtattcagtgaaacctttatatcccttatggtcctccatcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgcccccgaaaaacttgtcatccctactatcttctgtctagtcatactcctattcacctttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcattctctaatcagatatcctgagtcatcccaattcttagaccttttatacctgtttttctccttctgttattccatttagtttctcaattcatccaaaaccatatccaggccatcaccaatcattctatacgacaaatgtttcttctaacaaccccacaatatcaccccttaccacaagacctcccttcagcttaatctctcccactctaggttcccacgccgccccaatcccgcttgaagcagccctgagaaacatcgcccattctctctccatatcaccccccaaaaattttcaccgccccaacacttcaacaccattttgttttatttttcttattaatataagaaggcaggaatgtcaggcctctgagcccaagccaagccatcgcatcccctgtgacttgcatgtatatgcccagatggcctgaagtaactgaaaaatcacaaaagaagtgaatatgccctgccccaccttaactgatgacattccaccacaaaagaagtgtaaatggcctgtccttgctttaagtgatgacattaccttgtgaaagtcattttcctggctcatcctggctcaaaaagcacccccactgagcaccttgcgacccccactcttgcccgccagagaacaaaccccctttgactggaattttcctttatctacccaaatcctataaaacggccccacccttatctcccttcactgactctcttttcagactcagcccacctgcacccaggtgaaataaacagccatgttgctcacacaaagcctgtttggtggtctcttcacacggatgtgcatgaaa

SEQ ID NO: 234 - DNA, 668 bp, Homo sapiens
ttatagaaagtagtcaggcagacatgggcagagcaggagagggcccacccccaaccccatcagaaatgtcaggtgaccatcaggtgataggttaagctgtctctctaaaataataattggtcacagctggcaccagggaaaggcagtcacccaacagaaactggtgatcagcagcttcctggtaagatctcaggaggtgggtgagtgggctcaagcatgtgcactaagaggcaaaatggtggagtttaattggtatatgaccttcttccatgaacactgggctggtaagggaaaaatgcctcaagtgagcatgagtacaatttcagtaaacacactgtgtatgtggcccctcccaagtgctggcaggtcactgcacatgtgacagccacctcaaaggatgaattgggagaagtaacacaaccctggaagcatgccaatgtataagactccaagtcaaaggtcaaaccatgcacttgatctcttaggttgcccgcctggccttcttccaagtgtactttacttcctttcattcttgctctaaagcttttaaataaactttcacttctgatctaaaacttggttcagtctctccctctgccttatgcccctcagttgaattctttcttctgagggggcaagaattgaggttgctgcaaactcggatttgc

SEQ ID NO: 235 - DNA, 212 bp, Homo sapiens
cccccagtcacataccccctgcttgctcaatcaatcatgaccctctcatggccacccccttagagttgtgagcccttaaaagggacaggaattgctcacttggggagctcggctcttgagacaggagtcttgctgatgcccccggccaaataaaccccttccttctttaactaggtgtctgaggagttttgtctatggcttgtcctgctaca

SEQ ID NO: 236 - DNA, 386 bp, Homo sapiens
gtcaggcctctgagcccaagctaagccatcatatcccctgtgacctgcacgtacacatccaggtggctggttcctgccttaactgatgacattccatcacaaaagaaatgaaaatggcctgttcctgccttaactgatggcattatcttgtgaaattccttctcctggctcatcctgtctcaaaagctcccctgctgagcaccccactcctgcctgccagagaacaaccctcctttttcctttacctacccaaatcctataaaacggccccacccctatctcccttcacttttcggactcagcccacctgcacccaggtgaaataaacagctttattgctcgcacaaagcctgtttggtggtctcttcacacggacgcgagtgaaa

SEQ ID NO: 237 - DNA, 435 bp, Homo sapiens
gtcaggcctctgagccgaagccaagccatcagactccctgtgacctgcacgtatacatccagatggcctgaagcaactgaagaacaacaagaagaagcgaaaatagctagttcctgccttaactgatgacattccaccattgtgatttgttcctgccccaacctaactgatcaattgaccttgtgacattccttctcctggacaatgaatctcaggagctccccactgagcaccttgtgatccccgcccctgcccgcaagagaacaacctcctttaactgtaattttccactatctacccaaatcctataaaactgcccgacccctatctccctttgctgactccttttctgaactcagtctgcctgcacccaggtgattaaaagctttattgctcatacaaagcctgtttggtggtctcttcacatggacgcac

SEQ ID NO: 238 - DNA, 447 bp, Homo sapiens
gtcaggcctctgagcccaagccaagccattgcatcccctgtgacttgcacgtatacgcccagatggcctaaagcaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaccaccccaactgagcaccttgtgacccccactcctgcccgccagagaacaaaccccctttgactgtaattttcctttacctacccaaatcctataaaatggccccacccttatctcccttcactgactctcttttcggactcagcccacctgcacccaggtgaaatagccatgttgctcacacaaagcctatttggtggtctcttcacacggacgagcatgaaa

SEQ ID NO: 239 - DNA, 714 bp, Homo sapiens
ttacagtaggtagctagtcagacatgagcagggcaggagagtgccaaaccccaccaggaatgtcaggcaaccatcaagtgtggtcaggtggcgttaagctgtctctctaaaataataattggtcacagccagtgccagagaaaagcagtctcccgatagatggaaaaaaacctgaaactggtgatcagcatcttcccaataagatttcaagatttggttgagtgggctcaagcatgtacactaagaggcaaaatggtggagtttaactggtgtgcgaccttctaggaacattgaactggtaagggaagaacgcctcaagtgagcatgcgtgcaactccagtaaacacgctgcacatgcagctccttccaagggctggcaggccactgtgcatgcagagagcccaccctaagggaagaatcaggagaggagagatgcaaactctggaagcatgccaacatttaaagccccaagtcaaaggtcaaactgcgcacttgatctctcaagtcgcctgcttggctctcttccaagtgtactttactcccttttgttcctgctctaaagctttttaataaactttcactcctgctctaaaacttgccttggtctctcactctgccctgtgcccctcggttgaattctttcttgtgaggaagcaagaactgaggttgctgcagacccgtatggattcgccgctgctaacataatttggtacc

SEQ ID NO: 240 - DNA, 6860 bp, Homo sapiens
caggcctctgagcccaagctaagccatcatatcccctgtgacctgcacgtatacatccagatggcctgaagcaactgaagatccacaaaagaagtgaaaatagccttaactgatgacattccaccattgtaatttgtttctgccccaccctaactgatcaatgtactttgtaatcgccccaacccttaagaaggttctttgcaattctccctatccttgagaatgtacttcgtgagatccaccccctgcctgcaaaaaattgctcctaactccaccgcctatcccaaaacctataagaactaatgataatccaccaccctttgctgactctctttttggactcagcccacctgcacccaggtaatataaacagccttgttgctcacacaaagcctgtttggtggtctcttcacacggacatatgagacatttggtgccaaagaccccggtcagcgggactccttcaggagaccagtcccctgttcttgccctcactccatgaagagatccacctacgacctcgggtcctcagaccaaccagcccaaggaacatctcaccgattttaaatcgggtaagtggcctctttttactctcttctccaatctctctcactatccctcaacctctttctcctttaaatcttggtgccacccttcaatctgtcccttctcataatttcaattcctttcattttctggtagagacaaaggagacacattttatccgtggacccaaaactccggcgcaggtcacagactcgggaaggcagccttcccttagtgtttaatcattgcaggtcgcctgcctgattattcacccacgtttcagaggtgtctgacctcacggggacacctgccttggtccttcacccttagcggcaagcaccacttttctggggggcaagcaccccttgacaccttctctccatgtctccaccccttctccactttcctggggggcaagcactccccaccccttctctccgtgtctctactctctcttttctctccacttttctgggggacaagcaccccccaccccttctctccatttctctactctctcttttctctccactttcctgggaggcaagcaccccccactccttctctccatgcctctactctctcttttctctccacttttctggggaacaagcaccccccaccccttctctccgtgcctctactgtcttttctctccacttttctggggggcaagcagcccccacctcttctgtctgtgtctctatcccttctccactttcctggggggcaagcacctcccaccccgttcccactttcctgggggacaagcacctcccaccccattcccactttcctggggggcaagcacctcccaccccgttcccactttcctggggggcaagcacctcccaccccattcccactttcctgggggacaagcacctcccaacccgttcctactttcctggggggcaagcacctcccaccccgttcccactttcctgggggacaagcacctcccaacccgttcctactttcctggggggcaagcacctcccaccccgttcccactttcctggggacaagcacctcccaccctgttcccactttcctggggggcaagcacctcccacctcattcccactttcctgggagataagcacctcccaccccgtttcaactttcctggggggcaagcacctcccaccccttctccactttcctggggggcaagcaccccctaccccttctctccatgtctctacccttctctttaaacttgcctccttcactatgggcaaccttctaccctccattcctccttctcccttagcctgtgtcctcaagaacttaaaacctcttcaactctcgcctgacctaaaacttaaacgccttattttcttctgcaatactgcttgaccccaatacaagctcgacaatggttctaaatggccagaaaacggcacttatgatttctccatcctatgagatctagacaatttttgtcaaaaaatgggcaaatggtctgaggtgcctgacgtccaggcattcttttacacattggttcctccctagtctctgctcccagtgagactcgtcccaaatctttcttctttctctcctgtctgttccttcagtctccaccccaagctcttgagtcctttgaatccttcttttctacggactcatctgacctctccccttctccccaggctgctcctcgccaggccaagccaggtcccaattcttcctcagcctctgcttccgcaccctataatccttctatcacctcccctcctcacacccagtctggtttacagttttgttccgtgactagtcctcccccacttgcccaactatttcctcttaaagacgtggctggagctgaaggcatagtcaacgttaatgctcctttttcctctatcagacctttcccaaatcagccagcgtttaggctctttctcatcagaccccactaaatatatacaggaattccgatatctaactctgtcctacaatttaacctggagtgacttaaatgtcatcctgacttctaccctctccccggatgaatgggaaagagttttttctccagcccaatctcacactgataaccactggcttcatgagccagacctccaggaaggcattagagcagttccccgagaagatcccaatggaactatcaggcagattccccaggtatagctaggcgagattacatggtttcctgcctagttaaagggcttaaaaaggcagcttacaaagctgttatgacaaacttaaagaaactacccgaggtaaagacgaaagcccagcccagttcatggccctcttagcagcaaccctgagacactttactgccctagacccagaggggccagaaggccgtcttaatctcaatatgcattttattttattaaccaatttgctcccaacattaaataaagctccaaaaattaaattcggccctcgaaccccacaacaggacttaattaacctcgcttcaaggtgtacaataatagagtagaggcagccaagtagcaatgtatttctgagttgcaattccttgcctccactgtgagacaaaccccagccacatctccagcacacaagaactccaaacacctgaaccgccactgccaggggttcctccagaaactccttccccaggagcttgctacaagtgctggaaatctggccactgggccaagcaatgcccgcagcctgggactcctcctaagccatgtcccatctgtgcgggaccccagtggaaatcggactgtccaactcacctggcagccactcccggagcccctggaactctggcccaaggctctctgactgactcattcccagatattctcagcttagtggctaaagactgacgctgcctgatcacctcggaagccccctggaccatcacagaccctttgggtaactcttacagtggagggtaagtccgtctccttcttaatcaataaggaggctaccaactccacattaccttcttttcaaaggcctgtttcccttgcctccataactgttgttggtattgacggccaggcttctaaacctcttaaaactccccaactctggtgccaacttggacaatattcttttatgcactcattttagttatccccacctgcccagctctcttattaggtcgagacattttaactaaattatctgcttccctgactattcctaggctacaagcacacctcattgccacccttttccccagttcaaagcctcctttgcatcctcctctcgtatccccctaccttaacccacaagtatgggatacctctactccctccttggtgacaaatgatgcaccccttaccatcccattaaaacctaatcacccttaccccactcaatgccaatatcccatcccacagcatgctttaaaaggattaaagcctgttatcacttgcctgttacagcatggccttttaaagcctgtaaactctccctacaattcccccattttacctgtcctaaaacaagacaagccttaccttagttcaggatctgcgccttatcaaccaaattgtcttgcctatccaccccatggtgccaaacccatatactctcctatcctcaataccaccctccacaacccctccataaccccttattctgttctggatctcaaacatgctttctttactattccttgcacccttcatcctagactctctttgctttcacttggactgaccctgacacccattagactcacaaattacctgggctgtactgccacaaggcttcacggacagcccccattacttcagtcaagcccaaatttcttcctcatccattacctatctcgacataattcttcatgaaaatacacatgctctccctgctgatcacgtctgactaatctcccaaaccccaatgccttctacaaaacaacaactcctttccttcctgggcatggttggatacttttgcctttggatactggttttgccatcctaacaaaaccattatataaactcacaaaaggaaacctagctgaccccacagatcctaaatccttttgccactcctttccgttccttaaaaacagccctagaagctgcccccacactagctctccctaactcatcccaatcctttttcattacacacagccaaagtgcagggctgtgcagtcggaatttttacacaagagctgggactgcgccctgtagcctttttatccaaacaacttgaccttactgttttagcctagccttcatgtctgtgtgcagtggctgccgctgccttaatacttttagaggccctcaaaatcacaaactgtgctcaactcactctctatagttctcataacttccaaaatctattttcttcctcacacctgacgcatataatttctgcccccctccactacctctcagcaagccaaactcattgtcttaactcaagccctcactcttgcaaagggactacgcgtcaatatttatactgactgtaaatatgccttccatatcctgcaccaccatgctgttataagggctgaaagaggtttcctcactatgcaagggtcctccatcattaatgcctctttaataaaaactcttctcaaggccgctttacttccaaaggaagctgaagtcattcactgcaaaggccatcaaaaggcataagatgccatcactcagggcaatgcttatgctgacaaggtagctaaaaaagcagctagagttccaacttctaaccctcatggcagtttttctccttctcatctggtcattctcacctattcccccactgaaacttccacctatcaatctcttcccacacaaggcaaatggttcttggaccaaggaaaatatctccttccagcctcacaagcccattctagtctatcgtcatttcataacctcttccatgtaggttacaagcagctagcccgcctcttagaacttctcatttcctttccatcatggaaatctgtccttaaggaaatcacttctcagtgttccatctgctattctactactactcctcagggattgttcaggctgcctcccttccctacacatcaagctcggggatttgcccccgcccaggactggcaaattgactttactcacatgcctcaaatcaggaaactaaaatacctcttggtctgggtagacactttcactgggtgggtagaggcctttcccacagggtctgagaaggccaccgtggtaatttcttcccttctgtcaaacataattccttggtttggccttcccacttctatacagtccaataacagaccggcctttattagtcaaatcacccaagcagtttctcaggctcttggtatttagtggctccaggttttacctcaaactgccacccttaagtctctctttaagtggatagaagttcttcagtgacaaagtacactccaatactttcaccctgatgaagtcctattctttacttttatacttgctcttattcttgtccccatttttatgccactctctacctctccccagctatctccaccacactatatcagtctcagtcactctctcctagccatttctaatccttctttaacaaacaattgctggctttgcttttctctttcctccaaaattcccgaggccctgactaaaaaaggggtactcttgtatatttttaaatgaagaaaaaaaggggactctgtatatttttaaatgaagagtgttgtttttacctaaatcaatctggcctggtatatgacaacataaaaaaactcaaggatagcacccaaaaactcaacaaccaagcaaataattatgctgaactcccttggacactctgtaattggatgtcctgggtactcccaattcttagtcctttaatatctgtttttctccttctcttatttggaccttgtgtctttcatttagtttctcaattcatacaaaaccgcatccaggccatcaccaatcattctatacgacaaatgtttcttctaacaaccccacaatatcaccccttaccacaaaatcttccttcagcttaatctcacccactctaggttcccacgtcacccctaatcctgctcgaagcagccctgagaaacatcacccattatctctccataccacccccaaaaactttcgccaccccaacacttcaccactattttgttttatttttcttattaatataagaagacaggaatgtcaggcctctgagcccaagctaagccatcatatcccatgtgacctgcacatatacatccagatggcctgaagtaactgaagatccacaaaagaagtgaaaatagccttaactcatgacattccaccattgtaatttgtttctgtcccaccctaactgatcaatgtactttgtaa

SEQ ID NO: 241 - DNA, 974 bp, Homo sapiens
gtggggaagagagagatcagtgtctctttctatacggactgtgtctatatagaaagaagtagacatgagagactccattttgttctgtactaagaaaaattcttctgccttgagatgctgttaatctgtaaccctaccccaaccctgtgctcgcagaaacatgccctgtgtcgactcaaggtttaatggatttagggctatgcaggatgtgctttgttaaacaaatgcttgaaggcagctagcttgttaaaagtcatcaccactccctaatctcaagtacccagggacacaaaacactgcggaaggaaggccgcagggacctctgcctaggaaagccaggtttctccccatgtgatagtctgaaatatggcctcatgggaagggaaaagacctgaccgtcccccagcccgacacccgtaaagggtctgtgctgaggaggattagtaaaagaggaaggcctctttgcagttgagataagaggaaggcgtctgtctcctgctcatccctgagcaatggaatgtctcggtgtaaaacccgattgtatattccatctactgagataggagaaaaccgccttagggctggaggtgagacatgctggcggtaacactgctttttaatgcaccgagatgtttatgtatgtgcacatcaaagcacagcaccttttccttaacattgtttatgacacagagacatttgttcacattttcctgctggccctctccccactattaccctattgtcctgccacatccccctctgggagatggtagagatggtagagataatgatcaataaatactgagggaactcggagactggggccagcgtgggtcctctgtatgctgagcgccagtcccctgggcccatttttctttctctgtactttgtctctgtgtctctttcttttctcagtctctcatcccaccccacgagaaacacccacaggtgtggaggggcaggccaccccttca

SEQ ID NO: 242 - DNA, 769 bp, Homo sapiens
gagagacaggactagctggatttcctaggccgactaagaattcctaagcctagctggggaaggtgaccgcacccgcttttaaacacagggcttgtaactcagctcacacctgaccaatcaggaagtaaagacagctcactaaaataccaattaggctaaaagcaggaggtaaagaaatactcaatcatctatcgcctgagagcacagggagagacaatgaccgggatataaacccaggcattggatccggtgtggcaaccccctttgggtcccctccccttgtatgggagctctgttttcactctattatatcttgcaactgcgcgctcttctggtccgtgtttgttctggctcgagctgagctttcactcaccgtccgccactgctgattgctgccgtcgcagacccgccactgacttccaccctccagatccagcccggtgcctgctgtgctcctgatccagcgaggcgcccgttgccgctcccggtcgggctagaggctcgccattgttgctgcgcggctaagtgcccaggttcatcctaattgagctgaacgctagtcgctgggttccacggttctcttctgtgacccacggcttctaatagagctataacaactcacctcatggcccaacgttccattccctggaatccgtgaggccaagaaccccaggtcagggaacaaaaggcttgtgccatcttgggagcggcccccccaccatcttgggagctctaagaacaaagacctgctggtaacacaattttggta

SEQ ID NO: 243 - DNA, 5827 bp, Homo sapiens
gtcaggcctctggtcccaagcctgcacatatacatccagatggcctgaagtaactgaagaatgacaaaagaagtgaaaatggtcggttcctgccttaactgatgacattaccttgtgaaataccttctcctggctcatcctggctcaaaagctcccccactgagcaccttgtgacccccacacctgccagccagagaataactcccttttactatacttttccactacctacccaaatcctataaaacggtctcacccctatctccctttgctgactctcttttcagactcagcccgcctgcacccaggtgattaaaaaggtttattgctcacacaaagcctgtttggtgatctcttcacacggatgcaggtgaaatttggtgtcatgactcggatcaggggacctcccttgggagatcaataccctgtcctcctgctctttgctccatgagaaaggtgcacctacaacatcgggtcctcagaccaaccagcccaaggaacatctcaccaattttaaatcatgtaagcggcctctttttactctcttctccaacctctctcactatccctcaacccctttctcctttcaatcttggtgccatccttcaatctctcccttctcttaatttcaattcttttccttttctggtagagacagaggagatgtgttttatccacgaccccaaaactccggtgctggtcatgaactcaggaaaacagtcttcccttggtgtttaatcactgcaaggatggctgcttgattattcacccacgtttcagaggtgtctgatcaccgcggggatgcctgccttgatccttcacccttagcggcaagcactgcttttctgggggcaagcagcccccaccctttctctccgtgtctctaccccttttccacttccctgggaggcaagcacctcccacccttctccactttccttgggggcaagcaccccccaccccttctctccatgtcctctcttttctctgggcttgcctccttcactatgggcaaacttccaccctccattcctccctcttctcccttagcctgtgttctcaaaaacttaaaacctcttcaactcacacctgacctaaaacctaaatgccttattttcttctgcaacaccgcttggccccaatacaaacttgataatggctctaaatggccagaaaactgcattttcagtttctccatcctacaagacctagataatttttgtcaaaaaatgggcaaatggtctgaggtgccttacatccagacatttttcacacttcgttccctccctagtctctgttcccaatgcaattcctcccaaatcatccttgtttccctcccgcctgtcccctcagtcccaacctcaagcatcgctgagtctttccaatcttccttttctacagacccatctgacctctctcctcctccccaggctgctcctcaccaggccaagccaggtcccagttcttcctcagcctctgctcctccaccctataatctttctatcacctcccctccttacacctggtctggcttacggtttagttctgtgactagctctccccaacctgcccaacaatttcctcttagagaggtggctggagctgaaggcatagtcagggtacatgtgcctttttctctatcggacctctctcagatcagtcagcgtttaggatctttctcatcaggccctactaaatatatacatgaattccaatatctaactctgtcctacaatttaacctggagtgacttaaatgtcatcctaacttttatcctcccactagatgaatgggaaagagttttttctctggcccaatctcacactgacaactgtcggctccacaagccagacctccaggaaggcattagagaagttccccaagaggatccccaatggaactatcaggaaaattccccaggtatagctaggcgagattacatgatttcctgcctagttgaagggcttaaaaaggcagcttacaaagctattaattatgacaagcttaaagaaactacccaaggtacagacaaaaacccagcccagtccatggcttgtttggcagcaaccatgagacactttgcagccctagaccctgaaggtcagaaggctgtctcattctaaatatgcattttatcacccagtcagctcctgacattagaaaagaacttcaaaaattagaatccggccctcaaaccccacaataggaattaatcaacctcgccttcaagatgtacagtaatagagaggagacaggcagatggcaacgcatttctgagttacaattacttgcctctgctgtgagacaaaacccagccgcacctccagcacacaagaacttcaaaatgcctaagctgcacatgcctaagccacagcagtcaagcattcctacaggacttcctccatcaggatcttgcttcaagtgccagaaatctggccactgggccaaggaatgcctgcagcctgggattcctcccaagctgtgtcccatctgtgcagggacccactggaaatcagactgcccagctcacccagcagccactcctagagctgctaaagctctaggccaaggctctctgactgactccttcccagatctgctcagcttagcggctgaagactgacgctgcccaatcacctcagaaaccccctggaccaacacggactccgagtttcgggtaattctcacagtggactgaccctgacacccatcagtcccagaagcttacctgggctgtgctgcctcaaggcttcagggacagccctcattacttcagccaagctctttctcatcatttactttctttccacccctccacttctcaccttattcaatatattgatgaccttctactttgtagcccctccattgaatcttcccaacaagacaccctcctgctccttcaacatttattctccaaagggtatcgggtatcccccaccaaagctcaaatttcttctccatccgttacctacctcagcataattcttcataaaaacacacatgctctccctactgatcacgtccaactgatctctcaaaccccaaccctttctacaaaacaactcctttccttcctaggcatggttggatactttcacctttggatacctggttttgccatcctaacaaaaccattatataaactcacaaaaggaaacctagctgaccccatagatcctaaatcttttccccactcctctttccgttccttgaagacagctttagagactgctcccacactagctctccctgactcatcccaatccttttcattacacacagccgcagtgcagggctgtgcagctggaattcttacacaaggaccgggactgtaccctgtagcctttttatccaaacaacttgaccttactgttttaggctggccatcatgtctccgtgcagcggctgccaccgccctaatacttttagaagaccccaaaatcacaaactatgctcaactcactctctacagctctcataacttccaaaatctattttcttcctcacacctgacacatatactttctgctccccagctccttcagctatactcactctttgttgagtctcccacaattaccattgttcctggcccagacttcaatccagcctcccacattattccagataccacacctgacccccatgactgtatctctctgatccacctgactttcaccccatttccccatatttccttctttcctgttcctcaccctgatcacatttggtttattgatggcagctccaccaggcctaatcagcactcaccagcaaaggcaggctatgctatagtatcttccatgtctatcattgaggctaccactctgcctccctccactacctctcagcaagctgaactcattgccttaacttgggtcctcactcttgcaaagggactacacatcaatatttatactgactctaaatacaccttccatatcctgcactaccatgctgttatatgggcagaaagaggtttcctcactatacaagtgtcctccatcattaatgcctctttaataaaaactcttctcaaggctgctttacttccaaagaaaggtggagtcattcactgcaagggccaccaaaaggcatcagatcccattgctctaggcaatgcttatgttaataaggtagctaaagaagtagctagcattccaacttctgtccctcatggccagtttttctccttctcatcggtcactcccacctactcccccactgaaacttccacctatcaatctcttcccacacaaggcaaatatcttagaccaaggaaaatatctccttccagcctcacaggcccattctattctgtcatgatttcataacctcttccatgttggttacaagctgctagcccgtctcttagaacctctcattttctttccatcatggaaatctgtcctcaaggaaatcacttctcagtgttccatccgctagtctactgtccctcaggtattgttcaggccccctcccttccgtacacatcaagcttggggatttgcccctgctcaggactggcaaattgactttactcacatgtcctgagtcaggaaactaaaatacctcttggtctgggtagacactttcactggatgggtagaggcctttcccacagggtctgagaaggccaccgtggtcatttcatcccttctgtcagacataattcctcagtttggccttcccacctctgtacagtctggtaacggaccggcctttactagtcaaattacccaagcagtttctcaggctcttggtattcagtggaaccttcataccccttaccatcctcaatcttcaggaaaagtaaaacagactaatggtcttttaaaaacacatctcaccaagctcagcctccaacttaaaaaggactggacaatacttttaccacttgcccttctcagaattcgggcctgtcttcaggatgctataggttacagcccatttgagcttctgtatggacactcctttttattaggccaccagcccacttgaactgcaccccaaaaacttggatagagcctaaaaactcaccaaccaagcaagcaattacgctaagccccctcggcactctctaattggatgtcctgggtcctcccaattcttagtcctttaatacctgtttttctccttctcttatttggaccttgtgtcttccgtttagtttctcaattcatacaaaactgcattgaggccatcaccaatcattctatatgacaaatgctccttttaacaaccccacaatatcgcctcttaccacaaaatcttccttcagcttaatctctcccactctaggttcccatgctgcccctaatcccgctcgaagcagccctgagaaacatcacccattatctctccataccactgccaaaacttttcactgccccaacactttaccactatttcattttatttttcttattaatataagaagacaggaatgtcaggcctctgggcccaagcctgcacgtatacatccagatggcctgaagtaactgaagaatgacaaaagaagtgaaaatagccagttcctgccttaactgatgacattaccttgtgaaacatcttctcctggctcatcctggctcgaaagctcacccactgagcaccttgtgaccctgacccctgctagccagagaacaaccccctttgactgtaattttccactacctacccaaatcctataaaatggccccacccctatctccctttgctgactctcttttcggactcagcctgcctgcacccaggtgattaaaaagctttattgctcacgcaaagcctgtttggtggtctcttcacatggatgcgcatgaaa

SEQ ID NO: 244 - DNA, 652 bp, Homo sapiens
ttacagtaggtaggcagacatgagcagcgtgggaggggtcccccccaccacccccaacaggaatatcaggcgaccatcaggagatgatggtcaggcagttcttaaatgtctctctaaaataataattggttgcagccagcgccagagaaaggcagtctcctagtagacagaaaacacctgaaactggtgatcaacagcttcccgataaggtctcaggaactgcgtgagtgggctcgagcatgtgcacgaagaggtaaaatggcagagtttaactggtatatgaccttcctctaggagcactcgactggtaaggaaagaatgcctttagtgagcatgcgcacaactttagtaaacacactgcacatgcggcccctcccacgtgctggcaggccagtgtgcaggcggacagcccaccccaggggaagaatcaggggagaagtaacgcaaccccagaagcacactcaatgtactaaaccccaagtcaaaggtcaaactatgtacttgatctctaaagtcacccacttggccctccaagtgtacttccttttgttcctgctctaaagctttttaacaaactttcactcctgctctaaaacttgcctgggtctctcagtctgcctaatgcccctgggtcaaattctttcttctgagg

SEQ ID NO: 245 - DNA, 6489 bp, Homo sapiens
gtcaggtctctgagcccaagataagccatcatatcccctgtgacctgcacatatacatccagatggcctgaagtaactgaagaatcacaaaagaagtgaaaatggcctgttcctgccttaactgatgacactaccttgtgaaattccttctcccggctcatcctggctcaaagtctcccccactgagcaccttgtgacccccacccctgccagccagagaacaaccccctttgacagtaattttccactacctacccaaatcctataaaacggccccaccccatctcccttcactgactctcttttcggatcagcctgcctgcaccaaggtgaaataaacagccttgttgctcacacaaagcctgtttggtggtctcttcacacggacgtgagtgaaatttggtgctgtgactcggatcaggggacctccctcgggagatcaatcctctgtcctcctgctctttactccatgagagagatccacctacgacctcgggtcctcagaccaaccagcccaaggaacatctcaccaattttaaatcgggtaagcggcctctttttattctcttctcctccctctctcactatccctcaacctctttctcctttcagtcttggtgccatctttcaatctctcccttctcttaatttcagttcctttccttttctggtagagacaggagatgcgttttatctgtgaacccaaaactccggcaccggtcacagacttgggaagacagtcttcccttggtgtttaatcatgcagggatgcctgctttattattcacccatgtttcagaggtgtctgatcacacggggatgcctgccttggtccttcacccatagcagcaagcaccacttttctgggggcaagcaccccccaccccttctctctgtgtctctaccccttttccgcttttcttaggggcaagcactccccaatccttctctccatgtctccactctctcttttctctgggcttgcctccttcactacgggcaacctaccaccctccattcctccctcttctcccttagcctgtgttctcaaaaacttaaaacctcctcaactcacacctgacctaaaacctaaatgccttattttcttctgcaacaccgcttggccccaatacaaacttgacaatggctctaaatggccagaaaacggcactttcaatttcaccatcctacaagacctagataatttttgtcgaaaaatgggcaaatggtctgagatgccttacatccaggcatttttcacacttcattccctccctagtctctgtacccaatgcgattcctcccaaatcttccttctttccctcctgcctgtcccctcagtcccaaccccaagtgtcgctgagtctttccaatcttccttttctacagatcatccgacctctcccctcctccccaggctgctcatcgccaggctgagccaggtccaattcttcctcagcctccgctcctccaccctataatccttcgatcacctcccatcctcacacccagtctgtcttacagtttggatccaagactagctcttctccagctgcccaacaatttcctcttagagagtggctggagctgaaggcacagtcagggtacatgtgcctttttctctttcagacctctctcagatcagtcagcactcagaccctactgaatatatacaggaattccaatatctaactctgtcctacaatttaacctggagtgacttaaatgtcatcctaacttctaccctctccccagattcacaggaaattttttctctggcccaatctcacactgacaaccgctggctccatgaaccagacctccaggaaggcattagcgcagttccccgagaggatccccaatggaactatcaggcagattccccaagtatagctaggtgagattacatggtttcctgcctagttgaaggatttaaaaaggcagcttacaaagctgttaattatgacaagcttaaagaaactacccaaggtaaagacgaaaactcagcccagttcatggctcatttggcagcaaccctgagatgctttacagccctagaccttgaaggcccaggctttctgactgtctcattctaaatatgcattttatcacccagtcagctcctgacattagaaaaaaacttcaaaaattagaatccggccctcaaaccccacaacaggaattaatcaacctcaccttcaagttgtacaataatagagaaaagttacaattacttgcctccaccgtgagacaaaatcccagctacatctccagcacacaagaacttccaaacacctaaaccgcagcggccaggcattgctccaggaccccctccccaaggaacttgcttcaagtgctggaaatctggccactgggccaaggaatgccctcagcctgggattcctcctaagccgtgtcccatctgtgcgggaccccactggaaatcggactttctaactcgcctggcagccactcccagagcccctggaactctggcccaaggctctctgactgactccttcccagatcttctcggcttagcggctgaaggctgacgctgcccaattgcctcagaagcttcctggaccatcacagatgctttgggtaactcttacagtggaggttaagtccgtccccttcttcttcttctttttttttttttttgttttgagatgcagtcttgctctgtcgcccaggctggagtgcagtggcacgatctcagctcactgcaagctccgcctcccaggttcacgccactctcctgcctcagcctcctgagtagctgggactacaggcacctgcctctgcgcccggctaattttttttgtatttttagtagagacggggtttcactgtggtctcgatctcctgacctcgtgatccacccgcctcagcctcccaaagtgctgggattataggtgtgagccaccgcacccggccccttccccttcttaataaatagggaggctaccaactccacattaccttcttttcaaaggcctgtttcctttgcctccataactgttgcgggtattgacagccaagcttcaaaaccccttaaaactcccccactctggtgccaacttggacaacattcttttatgaagtcttttttagttatccccacctgcccagttccttattaggccaagacattttaactaaattatctgcttccctgactattcctaggctagagccacacctcattgccacccttcttcccaacccaaagcctcctttgcatcttcctctcgtatccccccaccttaacccacaagtatgggacacctccactccctccctggcaaccgatcacatgcccattactatcccattaaaacctaatcacccttaccccgctcaatgccagtatcccatcccacaataggctttaaagggattgaagcctgttatcattcgcctgttacaccatggccttttagagcctaaaatctctccttacaattcccccattttacctgtcctaaaaccagaaaagccttaccggttagttcaggatctgcgccttatcaaccaaattgttttacctatccaccccagggtgccaaacccatatactctcctctatcctcaatacctccctccacaacccattctgtcctagataaacctagctgaccccataaatcctaaatcctttccccactcccctttccattccttaaaaaacagccctaaaagctgctcccacactagctctccctaaatcatcccaaccttttcattacacacagccgaagtgcagggctgtgtggtcagagttcttagacaagagctgggactgcaccctgtagcctttttatccaaacaacttgaccttactgttttagcctagccctcatgtctgcatgtggcggctgccgctgccttaatacttttagaggccctcaaaatcacaaactatgctcaactcactctctacagttctcataacttccaaaatctattttcttcctcccacctgatgcatatactttctactccccagcttcttcagctatactcactctttgttgaatctcccacaattaccattgttccaggcccggacttcaatccggcctcccacattattccagataccacacctgacccccatgactatatctctctggtccacctgacgttcaccccatttccccacatttccttctttactgtttctcaccctgatcacatttggtttattgatggcagctccaccaggcctaatcgccactcaccggcaaaggcaggctatgctatagtatcttccacacctatcattgaggctactgctctgcccccctccattacctctcaacaagccaaactcattgccttaactcgagccctcgcccttgcaaaaggactatgtgtcaatatttatactgactctaaatatgccttccatattctgcaccaccatgctgttatatgggcagaaagaaatttcctcactatgcatgggtcctccatcattaatgcctctttaataaaaactcttctcaaagccactttacttccaaaggaagctggagtcattcactgcaagagccatcaaaaggcatcagatcccatcgctcaagacaatgcttatgctgataaggtagctaaaaaagcagctagctttccaacttctatccctcacggcagtttttctccttctcatctggccactcccacctactcccccactgaaacttccacctatcaatctcttcccacataaggcaaatggttcttgcaccaaggaaaatatctcctcgcagcctcacaggccccttctattctgtcatcatttcataacctcttccatgtaggttacaagctgctagcccacctcttagaacctctcatttcctttccatcgtggaaatctatccttaaggaaatcacttctcagtgttccatctgctattctactactcctcagggatttttcaggcctccctccattccctacacatcaagctcggggatttgcccctgcccaggactggcaaattgactttactcacatgccttgggtcaggaaactaaaatacctctggtctgggtagacactatcactggataggtagaggcatttcccacagggcctcagaaggccaccgtggtcatttcttcccttttgtcagacataattcctcggtttggccttcccacctctatacagtccaataatgggccggcctttattagtcaaatcacccaagcagtttctcaggctgttggtattcagtgaaaccttcacaccccttacggtcctcaatcttcaggaaaggtagaatggactaatggtcttttaaaaacacacctcaccaagctcagccaccaacttaaaaaggactggacaatacttttaccacttgcccttctcaaaattcgggcctgtccttggaatgctacagggtacagcccatttgagctcctgtatggacactcctttttattaggccccagtcttattccagacaccagcccaacttggactgcaccccaaaaacttgtcatctctactatcttctgtctagtcatactcctattcaccgtactcaactactcataaatgccctactcttgtttacactgctggtttacactgtttctccaggccatcacagctgatatctcctggtgctatccccaaacagccactcttaactccctcttaaagtaaataaataatctttgctggcagggccatgctgaacctccttgggcactctctaattggatggcctgggccctcccaattcttagtcctttaatatctgtttttctccttctcttatttggaccttgtgtcttccatttagtctctcaattcatacaaaacagcatccaggccatcaccaatcattctatatgacaaatgctccttttaacaaccccacaatattgcccttaccacaaaatcttccttcagcttaatctctcccactctgggttcccacgtcacccctaataccgcttgaagcagccccaagaaacattgcccattatctctccatagcacccccaaaaattttcgctgccccaacactttaccactattttgttttatttttcttattaatataagaagacaggaatgtcatgcctctgagcccaagctaagccatcatatcccctgtgacctgcaggtatacatccagatggcctgaagtaactgaagaatcacaaaagaagtgagaatggcctgttcctgccttaactgatgacactgccttgtgaaattccttctggctcaaaatctcccccattgagcaccttatgacccccacccctaccagccagagaacaaccccctttgactgtaattttccattacctacccaaatcctataaaatggccccacccctatctcccttcactgactctcttttcggactcagcccacctgcacccaggtgaaataaacagccttgttgctcacacaaagcctgttttgtggtctcttcacatggacatgagtgaaa

SEQ ID NO: 246 - DNA, 470 bp, Homo sapiens
accttcaagctccaaattatcctcagtgaggataccatcttctaaatactcaggagtcacccttctatagaagaccactaggctgcccatcagtagaacacaacaaaggaaaaatcctgtttgtgtttcccttggacctacctggatagcactttcaccaaaccacagagccactctgccctgacagttatcaagaggccaaaacccacaggacaactttcaccacccctctctcagtaggaagcagttatagacgcctgatctttgtccattttccccaagaactgggtcttggagtattgagggggaatgttagagtaggtagttagtcagacatgagcagggcatgaaagtggctcattctccccaggaatatcaggtgaccatcaggtgatggtcaagcagttgttaacctgtctctctaaaataattggttgcaacgggtgccagagaaaggccatctcccaata

SEQ ID NO: 247 - DNA, 6565 bp, Homo sapiens
agctgaaagtaaatatgcctcttatctcagcttcattaaaattatcttaagaagagggggagttaaagcttctacagaaaatctaattatgctatttcaaacaatagaacaattctgcccatggtttccagaacagggaactttatatttaaaagattgggaaaaaattggcaaagaattaaaacaagcaagtagggaaggtaaaatcatcccacttacagtatggaatgactgggccattattaaagcaactttagaaccgtttcaaatagaagaagatagtgtttcagtttctgatgcccctgagagctgtgtaatagattgtgaagaagaggcaggaacagagttcaagaaaggaatggaaagttcacattgtaaaaatgtagcagagtctgtaatggctcggtcaatgcaaaattgttgactataatcaattacaggaggtaatatatcctgaatcatcaaaattggcagaaggaggtccagaattatttgggtcatcagagtttaaaccacgacggccatcaactcctcctcctgcggttcagatgcctgtgacattacaacctcaaatgcaggttagacaagtacaaactgcaagagaatatcaagtagaaaaggatagagtctctatcccggcaatgccaatccagacacagtatccacaatatcagctggtagaaaataaaacccaaccactggtagtttatcaatactggccgccagtcaaatttcagtatcagctgcttccagaggttcagtatagatctcaggcggggtgtcctgtcccaaatagcagggcactatatcagcaacccacagcgatggcgtttgatcctacagcaccagctagtgtacaagatagtacactgcataaaaccattagccagaaaacagggagatcttgaggcatggcagtacccggtaattttacaaccgatactggctgggaaagggagtcaagcaggagcctctgtccaaactgagattagatatgaatctttcaccctgaaaatgttaaaagatatgaaggaaggagttaaacaatatggacccaactctccttatatgagaacattattagattccattgctcatggaaatagacttattccttatgattgggaaattttggctaagtcttccctttcaccctctcagtttctacagtttaaaacctggtggattgatggagtacaagaacaggtaaggaaaaatcaggctacttatcctgctgttaatatagatgcagaccaattgctaggaacaggtccaaattggagcactattaaccaacaatcagtaatgcagaatgaggctattgaacaactaaggactatttgcctcagggcttgggaaaaaaattcaggacccaggaacctcctgccattcttttagttcaatcagacaaggctctaagagccatatccagacttcgtggcaaggttgcaagatgccgctcaaaaatctattgcagatgataacgcctgaaaagttgttgtagaaataatggcttatcaaaatacaaatccagaatgtcaatcagccataaagccattaagagaaaatgttccagcaggagttgatgtaattacagaatatgtgaaggcttgtgatgggattggaggagctatgcataaggcaatgctattggctcaagcaattacgggggttgctttaggaggacaagttagaacatttggggggaaatgttataattgtggtcaaattggtcatctaaaaaagaattgcccagtcttaaataaacagagtaaaaataaagagccacctggcctgtgtccataatgtgaaagaggaaaacactgggctaaggaatgtcattctaaatttgataaaaatgggcaaccattatcgggaaatgggaagaggggccagcctcaggccccgcgacaaagtggggcgttcccgattcagccatttgttcctcagggttttcagggacaacaacccccacagcaaataccaccatttcagggaatcagccaattacaacaatacaacagttctcccccaccacagcgggcagcacagcagcagatttatgttctactcaaagggtttctttactccctggatagcccccgcaaaagattcctacaggggtatatggtacactgccagaagggatggtaggccttattttaggaagatcaagtctaaatttgaagggagtccaaattcatactggggtaattgattcagattataaaggggtaattcagttagtgattaactccactgttccctggagtgccaatccaggtgatagaattgctcaattattgctttgccttatattaaaattggggatagcaaaacagaaagaacaagagggtttggaagtaccaaccctgctggaaaatctgtttattggagtagtcagttctcagagaatagatctgtgtgtacagtcactattcagggaaagcagtttgaaagattagtggatactggggctgatgtttctatcattaccttaaatcagtggccaaaaaattggcctaaacaaaagtctgttacaggacttgttggtgtgggcgccacctcagaagtgtatcaaagtgccatgattttacattgtctaggacctaataatcaagagagtacagttcagcctatgattacttctattccaattaatttatggggccgagacttgttacaagagtggcatgcagagattactattccagtctccctatacagccccacaagtcaaaaaatcatgactaaaatgggatatctccctggcaaaggactaggaaagaatggagaaggcattaaagtcccaattaaggctaaggaaaatccagaaagaaaaggaatagagtatcctttttaggagtggccactgtagagcctccaaaacccattccattaacttggaaaacagaaaagcctgtatgggtaaatcagtggccactaccaaaacaaaagctggaggctttacacttattgacaaaggaacaattagaaaagggacataatgagccttcattttcgccttggaattctcctgtgtttgtaattcagaaaaaatcaggcagatggcgcatgctaactgacttaagagctgttaatgcagtaattcaacccatggggcctctccaacccgggctgccctctctagccatgattcccaaagattggcctttaattataattgatctaaaggattgccttttttaccattcctctggcaaaacaggattttgaaaaatttgcttttactataccagccataaatagtaaagaacaagccaccaggtttcagtggaaagtgttgcctcagggaatgcttaatagtccaactatttgtcagacttttgtagctcaggttcttcaaccagttagaaacaagttttcagactgttatatcattcattatgttgatgatattttgtgtgctacacaaatgagacaaattaattgactgttacacatatgtagtacaggctacaaaggatgttgagacagccctaatcaaatatagtatggatgatcagttaaatcagctgtttaatttgttacaacaaactgtaagaaaaagaaatttcccattttatattactcatattcaagcacacactaatttaccagggcctttaactaaagcaaatgaacaagctgacttgctactatcatctgcgtttatggaagcacaagaacttcatgccctgactcatgtaaatgcaacaggattaaaaaataaatttgatatcacatggaaacagtcagtgtcgagtcctacacctacccactcaggaggcgggaattaatcccagagatttatgtcctaatgcattatggcaaatggatgtcacacatgtaccttcacttggaaaattgtcatttgtccatgtgacagttgatacttattcacatttcatatgggcaacctgccagacaggagaaagtactcctcatgttaaaagacatttactatcttgttttgctgccatgggagttccagaaaaaaattaaaacagataacgggccaggatactgtagtaaagcatttcaaaaattcttaaataagtggaaaattacacatacaacaggaatcccttataattcccaaggacaggccataatagaaagaactaatagaacacttaaagctcaattggttaaacaaaaaaaaaaaaaaaaaaaaagaaagtaaggagcataacactccccagatgcaacttaatctagcactctttaaattttttagacatttataaaaataagaccactacttctgcagagcaacattttactggtaaaaaaaacagcccatatgagggaaaactgatttggtggaaagacattaaaaataagacatgggaaataggtaaggtgataacatgggggacaggttttgcttgtgtttcacaaggagaaaatcagcttcctgtttggatacccactaaacatttaaagttctacaatgaacccatctgagatgcaaagaaaagtgcctccacagagacagaaaacctgcaatcgagcatcattgactcgccaggtgaacaaaatggtgatatcggaagaacagatgaagttgccatccaccaagaaagcggagcagccgacctgggcccaacaaaagaagctgacacagttaactgaaaaaagcctgaaaaacacaagggtaacaaaaactccagagaatatgctgcttccagctttaatgattgtatcaacagtggtaagtctccctatgtctgcaggagcagctgcagctaattatacttactgggcctatgtgcctttcccacccttaattccggcagtcacttggatagataatcctattgaagtatatgttaataatagtgcatgagtaccaggccccacagatgaccatggccctgtccaacctaaagaagaagaaatgatgataaacatttccattgggtatcattatcctcctatttgcctggggaaagcaccaggatgcttaaggcctacaacccaaaaattggttggtagaagtacctactgtcagtgccaccagtaaatttacttattacatggtaagtggaatgtcgctcgggtcacaaatgaataatttacaggactcttcttatcaaagatcattaaaatttaagcctaaagaaaaaacttgccccaaggaaattcccaaagaatcaaaagacccaaaagtcttagtttgggaagaatgtgtggctgatactgcggtggtattacaaaacaataaatttggaactattatagactgggccccttgaggacaattatagtatgattgtatgggctagactcactcatattcacaggctccatctgtctggcccactaatccggcctatgatagtgatttgactgaaaggctagaccaggtttatataaggttagaatcaccctatccatggaaatggggtgaaaagggaatttcatcaccccaaccaaagttagttagtcttgttactggtcctgaacactcaaaattatggaagctcactgtggcctcgcaccgcattagaatttggtctggaaatcaagttatggaaacaagaaattgtaagccatattatactatcgacctaaattccaatctgacaattcctttgcaaagttgtgtaaaacccccttatatgctagttgtgggaaacatagttattaaaccagattccaaaactataacctgtgaaaattgtagattgtttacttgtattgattcaacttttgattggcagcaccatattctgctagtgagggcaaaagagggtgtgtggatccctgtgtccacggaccgaccatgggaggcttccccatctgtccatattttaatagaagtattaaaaggagttctaactagatccaaaagattcatttttacttcaattgcagtgattatggatcttattgcaatcacagctactgctgtggctgctggaattgctttacactgctctgttcaagctgcaaaatatgtaaataattggcaaaagaattcctcaaaattgtgaaattctcagactcaaatagatcaaaaattggcaagccaaattaatgatcttagacaactgtcatttggatgggagataggctcatgagcctgaaatatctttttcagttacagtgtgactggaatacatcagatttttgtattacacctcgagcctataataaatctgaacatcactgggacacggttagatgccatttacaaaaaagagaagataatcttactttaaatatttcaaaattaaaagaacaaatttttgaggcatcaaaagcccagttaaatctggtgccagaaactgaggcaatggtaaaagctgttgatagcctcacaaatcttaaccctgtcacttgggttaaaaccactgaaaattccactattgcaaattttgtattaatccttgtatgtctgttctctctgttgttagtctacaggtgtatccagcagcttcggagacacagcgaccggcgagaacgggacatgatgatgatggcggttttgtcaaaaagaaaagggggatatgtagggaaaagaaagtgagatcagactgttactgtatctatgtag

SEQ ID NO: 248 - DNA, 451 bp, Homo sapiens
gtcaggcctctgaggccaagccaagtcatcgcatcccctgtgacttgcgcgtatatgcccagatggcctgaagtaactgaagaatcacaaaagaagtgaatatgccctgccccgccttaactgatgacattccaccacaaaagaagtgtaaatggccggtccttgccttaagtgatgacattaccttgtgaaagtccttttcatggctcaccctggctcaaaaacacccccactgagcaccttgcgacccccactcctgcccgccagagaacaaaccccctttgactgtaattttcctttacctgcccaaatcctataaaacggccccacccttatctcccttcactgactctcttttcagactcagcctgcctgcacccaggtgaaataaacagccatgttgctcacacaaagcctgtttggtggtctcttcacacggacacgcatgaaa

SEQ ID NO: 249 - DNA, 412 bp, Homo sapiens
gtcaggcctctgagcccaagctaagccatcatatcccctgtgacctgcacgtacacatccacatggccggttcctgccttaactgatgacatttcaccacaaaagaagtgaaaatggcctgttcctgccttaactgatgacattgtcttgtgaaattccttctcctggctcatcctggctcaaaagctcccctactgagcaccttgtgacctccagtctgcccgccagagaacaacccccctttgactgtaattttcctttatccacccaaatcctataaaatggccccacccctatctcccttcaatgactctcttttcggactcagcccacctgcatccagatgaaataaacagctttattgctcacacaaaacctgtttggtggtctcttcacacggacaagcatgaaa

SEQ ID NO: 250 - DNA, 7906 bp, Homo sapiens
gtcaggcctttgagcccaagctaagccatcatacccctgtgacctacacgttatacatccagatggcctgaagcaattgaagatccacaaaataagtgaaaatagccttaacggatgacattccaccattgtgatttgtttccaccccaccctaactgatacatatattctcccccacccttaagaaggtacttcggaatgttctctcccgctcttaagaatgtgctttgtatgcctatcccaaacctgtaagaactaatgataatcccaccaccctttgctgactcttttttttggactcagcccatctgcactcaggtgaaataaacagccttgttactcacacaaagcctgtttggtggtctcttcacatggatgtgcgtgacatttggtgccgtgactaggattgggggccctcccttgggagatcaatcccctgtcctcctgctctttgctccatgagaaagatccacctacgactttgggtccttagaccaaccagcccaaggaacatctcaccaattttaaatcgggtaagcagcctctttttactctcttctccagcctctctcagtatccctcaatctctttctcctttcaatcttggcaccatccttcatttctcccttgtcttaatttcagttcatttccttttctggtagagacagaggagatgcgttttatccgtgaacccaaaactccggcactggtcatggattcaggaagacagtcttcccttggtgtttaatcactggagggatgcctgcttgattattcacccacgtttcagaggtgtctgatcacagtggggatgcctgctttgatccttcacccttagtggcaagcaccactttcctggggggcaagcacaccccactccttctctttgtgtctctaccctctcttttctctgggcttgcctccttcactatgggcaaacttccaccgtccattcctccttcttctcccttagcctgtgttctcaaaaacttaaaacctcttcaactcacacctgacctaaaacctaaatgccttattttcttctgcaatgctgcttaaccccaatacaaactcgacagtggttccaaatagccagaaagtggcacttttgatttttccatccaacaagatctagataattcttgtcgtaaaatgggcaaactgtctgagctgcctgatgtccaggcattcttttacacatcagtccctctctagtctctgttctcaatgtgactcgtcccaaatcctccttgtttccctcctgcctgtcccctcagtcccaaccccaagcatcactgtgtcttttcaatcttccttttctacagacccatctgacctctcccctcatccccagactgctccacctcgggtcactccctgccaggctgaatcaggctccaattctttctcagcctccactccccctaccctataatccttctatcaactcccctcctcacacccggtctggcttacactttcgttccacgactagccctctcccacttgcccaaaaatttcctcttaaagaggtggctggagctaaaggcatagtcagggttaatgctcctttttctttatccgacctctcccaaatcaattggcatttaggctctttttcatcaaatataaaaacccaactcagttcatggctcgtttggcagcatccctgagatgctttacagccctagaccctgaaaggtcagaaggccgtcttattctcaacatgcattttattacccaatccactcccgacattaaaaaagctccaaaaattagattctggccctcaagccccccaacaggacttaattaacctcgccttcaaggtatacaataatagagtagagtcagccaagtggcaacatatttctgagttgcaattccttgcctccactgtgaaagaaaccccagccacatctccagcacacaagaacttcaaaatgcatacaccgcagtggtcaagcattcctacaagacctcttccatcaggattttacttcaagtgccagaaatctggccactgggccaaggaatatctgcagtccgggattccttctaagccgtgtcccatctgcacaggaccccactgaaaatcagactgtccactgaaactcacccggcagccactcccagagcccctagaactctggcccaaggctttctgactgactccctcccagatcttcttggcttagtgactgaagactaatctcccaatcacctcagaagcttcctggaccatcacagatgctttgggtaactcttacagtggagggtaagtccgtccccttcttaatgtggagcctacccactccacattaccttcttttcaatggcctgtttcccttgcccccacaactgttgtgggtattgacggccaagcttcaaaaccccttaaaacttccccactctggtaccaacttggacaatattcttttatgcactcttttttagttatccccacctgcccagttcacttattaggctgagacattttaaccaatttatctgcttccctgactattcctggactacagccacatctcattgccacccttcttcccaacccaaagcctcctttgcatcttcctctcatatccccctaccttaacccacaaatatgggacaactctactccctttcctggcaaccgatcacatgcccattactagcccattaaaacctaatcacccttatcctgctcaatgccagtatcccatcccacaacaggctttaaggggattgaagcctgttatcactcacctgccactgcatgtacttctaaaacttataaactctccttacaattctcccattttacgtgtccaaaaactggacaagtcctacaggttagttcaggatctgcaccttatcaaccaaattgttttgcctatccaccctgtggtgctcaacccatacacccttttgttctcaataccttcctccacaactcactattccgttcttgatcttaaagatgcttttttcactattcccctgcaccccttgtcccagccactccttgcttttacctgggatgaccctgacacccatcagtcccagcagcttacctgggctgtactgccacaaggcttcaggggtagccctcattacttcagccaagctctttctcatgatttactttctttccacccctccacttctcaccttattcaatatattgatgaacttctactttggagcccctcctttgaatcttctcaacaagacaccctcctgctccttcaacatttattctccaagggatatcgggtatccccctccaaacctcaaatttcttctccatctgttacctacctcggcataattcttcatgaaaacaaacttgctctccctgctgattgtgtctgactgatctctcaaaccctgaccccttctacaaaacaacaactcctttccttcctgggaatggttggataatttttagaggccctcaaaatcacaaactatgctcaactcactctctgcagttctcataacttccaaaatcaattttcttcctcacacctgacacatatactttctgctccccgactccttcagctatactcactctttgttgagtctccctcaattgccattgttcctggcccagacttcaatctagcctcccacattattccagataccacacctgacccccatgatggtatctctctgatccacctgacattcaccccatttccccatatttccttctttcctgttcctcaccctgatcacacttggtttattgatggcagttccaccaagcctaatcatcactcaccagcaaaggcaggctttgctatattatctttcacatttatcattaaggctaccgctctgccccctccactacctctcagcaagccaaactcattgcctttacttgagccgtcactcttgaaaagggactacgtgtcaatatttataccgactctaaatatgccttccatatcctgcaccaccatgctgttataggggcagaaagaagtttcctcactacacagggttcctacatcattaatgcgtctttaataaaaactcttctcaaggccactttacttccaaaggaagctggagtcattcactgcaaggaccatcaaaaggtgtcagatcccattgctctggggagcgcttatgctgataaggtagctaaagaagcagctagtattccaacttctgtccctcatggccagtttttctccttgtcattggtcactcccacctactctcccatgaaacttccacctatcaatctcttcccacacaaggcaaatggttcttagaccaaggaaaatatccccttccagcctcacaggcccattgtattctgtcatcatttcataacctcttccatgtaggttacaagttgctagcctgcctctttagaacctttcatttcctttccactgtggaaatctatcctcaaggaaatcacttctcagtgtcccatctgctattctactacccctcagggattgttcaggccccctcctttccctacacatcaagctcagggatttgctcctgtccaggactggcaaattgactttactcacatgccccgagtcaggaaactaaaatacctcttggtctgggtagacactttcactggatgtgtagaggactttctctcagggtctgagaaggccaccatggtcatttcttcccttctgtcagacataattcctcagtttggccttctcacctgtatacagtccaataacagaccatcctttactagtcaaatcacccaagcagtttctgaggctcttggtattcagtggaaacttcataccccttaccattctcaatcttcggaaaggtagaacagactaatggtcttttaaagacacatctcaccaagctcagcctgtaacttaaaaaggactggacagtacttttacctcttgcccttctcagaattagagcctgtcctcaagatgctacagggtacagtccatttaaacttttgcatggacgtactttcttgcttggcccccaacctcatcccagacaccagccctctaggcgactatcctccagtcctccagcaggctagataggaaatttgccaggctgctaatattctcttgcctactccagattcccagccatatgaagacaccctagctggatggtcagttcttgttaagaatctgacccctcaaactctacaacctcaatggaccggaccctacttatctgtagtaccccaactgccgtttgcctgcaggatcctccccactgggtttactgttccagaataaagctgtatccaccagacagccagcctaatctctcctcttcctcctggaagtctcaagtactctcccctacttcacttaaactcactcacatttttgaagaacagtaataactcttatgaacctaatacatcgtttcattctattaggtctattcgtccttaccctactttttgcaacaggactttatgcagtcacccccactacttggcctgaccccccaaaacttgtcatccctactgtcttctgtccagtcatactcctattcaccattctcaactactcataaatgccctactcttgtttacactgccagtttacactgtttctccaagccatcacagctaatatctcctggtgctatccccaaaccaccactctttactccctcttagagtggatagatgatctttggtggcaggacaccctccaatactttcaccacactatcaatctcattcactctttcctagccatttctaatccctccttagtgaacaattgctggctttgcatttccctttcttcctgtgcctatacagctgtccccgccttacagacagactgggaacatctcctgtctccctacacctccgaacttcctttaaccgccctcacctttgccctcctgaagaacttctttactttctagacaggtccagcaagacctcctcagacatttcacatcagcaagctgccaccctcctccgcacttacttaaaaaacctttctccttatatcaactctactccccccatatttggacccctcagaacacaaactactattcctgtggccactcttttatgtatctctcagcaaagacccactggaattcccctgggtaacctttcatcttctcggtgttccttcagtcttcatctccaaagttcaactacacacatcactgaaacagttggaggcttccagctccatattacagataaaacctctatcaatactggcaaacttaaaaacatcagcagttattattgcttaggaagacacttaccctgtatttcactccatccttggctaccttccccttgctcgtcagactctcctcccaggccctcttcttatttacttatacccagccccataaataacagtgaaaggttgctcatagacactcaacgttttctcacacaccatgaaaatcaaacctctatgcagttatcccatcagtccccattacaactgctgatggctgtcaccctagctggatccctaggagtctgggtacaaaacagcttttttagtactccttctcatctttttactttgcatttccagttttgccttgcacaaggtctcttcttcctctgtggatcctctacctacatgcaaattggacaggcacatgcacactagttttccttactcccaaaattcaatttgcagatgggactgaagagcttcctgttcccctcataacactgacacaacaaaaaagaattattccactaattcccttgcttgtctgtttaggactttctgcctccactattgctcttggtactgggatagcaggcatttcaacctctgtcatgaccttccatggcctctctaatgactctccgctagcatcacagacatatcacaaactttatcagtccttcaggcccaagttgactctttagctgcagttgtcctccaaaacctccaaggccttgactttcactgctgaaaaaggaggactctatatttttaaatgaagagtgttgtttttacctaaatcaatctggcctgatgtatgacaacataaaaaaactcaaggatagagcccaaaaacttgccaaccaagcaagtaattatgctgaacctccttgggcactctctaattggttgtcttgggtcctcccaattcttagtcatttaatacctgtttttctccttctcttattcggaccttgtgtcttctgtttagtttctcagttcatccaaaaccatatccaggctgtcatcaatcattctatatgacaaatactccttctaacaaccccacaatatcaccccttaccacaaaatcttccttcagcttaatctctcccattctaggttctcacgccactcctaatcccacttgaagcagccctgagaaacatcacccattttctttccataccacccccaaaaattttcacagccccaacacttcaccactattttgtttttttcttattaatataagaagacaggaatgttaggcctctgagcccaagctaagccatcatataccctgtgacctgcacatatacatccagatggcctgaagcaactgaagatccacaaaagaagtgaaaaaagcaataactgatgacattccaccattgtgatttgttcttgccccaccctacatgtattctcccctgcccttaagaaggtactttgtaatattctctcccaccgctgccccctgcctttaagaaggtactttgtaatattctcccctacccttaagaatgtactttgtatgcctattcttaaacgtataagaactaatgataatcccaccaccctttgctgactctcttttcggactcagcctgcctgaatataggtgaaataaacagacttgttgctcacacaaagcctgtttggtggtctcttcacacggacacgcatga

SEQ ID NO: 251 - DNA, 5722 bp, Homo sapiens
gtcaggcctctgagcccaagccaagccatcgcatcccctatgacatgcacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttaggtaactcacagtggagggtaagtccgtccccttcttaatcaatacggaggctacccactccacattaccttcttttcaagggtctgtttcccttgcctccataactgttgtgagtattgacagccaggcttctaaacctcttaaaactccccaactctggtgccaacttagacaatactctttaaagcactcctttttagttatccccacctgcccagttcccttattaggctgagacactttaactaaattgtctgcttccctgactattcctggactacagctatatctcattgccgcccttcttcccaatcaaaagcctcctttgcgtcctcctcttgtatccccccaccttaacccacaagtataagatacgtctactccctccttggtgaccgatcatgcaccccttaccatctcattaaaacctaatcacccttaccctactcaacgccaatatcccatcccgcagcacactttaaaaaggttaaagcctgttatcactcgtctgctacagcatggccttttaaagcctataaactccccttacaattcccccattttacctgtcctaaaaccggacaagccttacaagttagttcaggatctgtgccttatcaaccaaattgttttgcctatccaccccgtggtgccaaacccgtatactctcctatcctcaatacctccctctactacccattagtctgttctagaactcaaacatgctttctttactattcctttgcacccttcatcccagcctctctttgctttcacttagactcaccctgacactgattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttatagtgcagtcagaattcttacacaagagccaggaccacaccctgtagcctttctgtccaaacaacttgaccttactgttttagcctagccctcatgtctgcgtgcagaggctgccgctgctttaatacttttagaggccctaaaaatcacaaactatgctcaactcactctctacatttctcataacttccaaaatctattttcttcctcatacctgacgcatatgctttctgctccctggctccttcagctgtactcactctttgttaagtcccacaattaccattgttcctggcccggacttcaatccggcctcccacattattcttgataccacacctgacccccacgactgtgtctctctgatccacctgatattcaccccattttcccatatttccttctttcctgttcctcaccctgatcacgcttgatttattgatggtagttccaccaggcctaatcgccacataccagcaaaggcaggctatgctatagtactagccactagcctgcctctcagaacctctcatttcctttccatcgtggaaatctatcctcaaggaaataacttctcagtgttccatctgctattctactactcctcagggattattcaggccccctcccttccctacacatcaagctcagggatttgcccccacccaggactggcaaattagctttacttaacatgcccgagtcaggaaactaaaatacctcttagtctaaatagacactttcactgaataagtaaaggcgtttcctacagggtctgagaaggccaccagtcatttcttccgttctgtcagacataattcctcattttagccttcccacctcaatacagtctgataacagatgagtctttattagtcaaatcagccaagcagtttttcaggctcttagtattcagtgaaacctttatatcccttacagtcctccatcttcaagaaaggtagaatggactgaaggtcttttaaaaacacacctcaccaagctcagccaccaaaaaggactggacaatacttttatcactttcccttctcagaattcaggcctgtcctcggaatgctacaaggtacagcccatttaagctcctgtatagatgctcctttttattaggccccagtctcattccagacaccggaccaacttagactgtgcccccaaaaaaacttgtcatccctactattttctgtctagtcatactcctattttccattctcaactactcatacatgccctgctcttgtttacactgccggtttacactgtttctccaagccatcatagctgatatctcctggtgctatccccaaaccgccactcttaactcttgaagtaaataaataatctttgctggcaggactatgctgaatttccttaggcactctctaatcagatgccctaggtcctcccaattcttagaccttttatacctgtttttctccttcttattccatttagtttttcagttcatacaaaaccgtatccaggccatcaccaatcattctatacaacaaatgtttcttctaacaaccccacaatatcaccccttaccataagatctcctttcagcttaatctctccgactctaggttcccacaccgcccctaatcccgcttgaagcagccctgagaaacatcgtccactctctctccataccactccacaaaaattttccccgccccaacacttcaacactatcttgttttatttttcttattaagaaggcaggaatgtcaggcctctgagcccaagccaagccattgcatcccctgtgacctgcatgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgacccccgctcctacccgccagagaacaaaccccctttgactgtaattttcctttacctacccaaatcctataaaacggccccacccttatctcccttcgctgactctcttttccgactcagcccgcctgcacccaggtgaaataaacagccttgttgctcacacaaagcctgtttggtggtctcttcacacagacgcgcatgaaa

SEQ ID NO: 252 - DNA, 547 bp, Homo sapiens
acagtaggcagctagtcaggcatgagcagggcagggagagggccccaccccaccacaccaggaatgtcagctgaccatcaggcgatggtcagccagttgttacactgtctctctagaatgataattgtttgcagcccgtgccagggaaaggcagtttcccaagagattagaaacacctgaagctggtgatcagcagcttcctgataagatctctgtagttgggtgagtgggctccagcaagtgtattaagaggcaaaatggcagagatcaactggtgtatgacctcccagggacattctgcgggtaaagggaaagaagacctcaagtgagctccactcaacactctgtgcatgctcacctcctaagtgctagcaggccactgtgcatgtgagcagctggccccaagggaagaatcagggaagaagggaagcaagaccccagaagtataccaactcataaaaccccaagtcaaaaggtcaagccacgcatttaattttcaacttgaccacttggccctcttccaagtgtatgtgctttctttacattc

SEQ ID NO: 253 - DNA, 7695 bp, Homo sapiens
gtcaggcctctgagcccaagccaagccattgcatcccctgtgacttgcacatatatgcccagatgtcctgaagtaactgaagaatcacaaaagaagtgaatatgccctgccccaccttaactgatgacactccaccacaaaagaagtgtaaatggctggtccttgccttaagtgatgacattaccttgtgaaagtccttttcctagctcatcctggctaggtgattttaaatcacccccactgagcaccttgtgacccccactcctgcctgccagagaacaaaccccctttgactgcaattttcctttacctacccaaatcctataaaacagccccacccttatctccctttgctgactctcttttcggactcagcccgcctgcactcaggtgaaataaacagccatgttgctcacacaaagcctgtttggtggtctcttcacaaggatgcacatgaaatttggtgccgtgactcggattgtgggacctcccttgggagatcaatcccctgtcctcctgttctttgctccgtgagaaagatccacctacgacctcaggtcctcagaccgaccagcccaagaaacatctcaccaacttcaaatccagtaagcggcctctttttactctcttctccaacctccctcactatccctcaacctctttctcctttcaatcttggcgccacacttcaatctctcccttctcttaatttcaattcctttcattttctggtagagacaaaggagacaccttttatccatggacccaaaactccggcgccggtcacagactgggaaggcagccttcccttggtgtttaatcattgcagggacgcctctctgattattcacccacgtttcaagggtgtcagaccacgcagggacgcctgccttggtccttcacccttagcagcaagtcccacttttctgggaaaggggcaagtacctcaaccccttctctccatgtctctaccccttctctgcttttctgggggaggggcaagtacccctcaaccccttctccttcactcttagtggcaagtcccacttttctagggggcaagaacccccaatcccttatttctgcaccccaacctcttatctctgcaccccaatcccttatttcctcaccctgacctcttatctctgtgccccaatcccttatttccgcacccagacctcttatctctgtgccccaatcccttatttccatgccccaaccccccttcccgcttttctggagggtaagaacccctgaaccccttccctccatgtctctactctctcttttctctgggtttgcctccttcactataggcaaaattccaccctccattcctccttcttctcctttagcctgtgtcctcaagaacttaaaacctcaacttacacctgtcctaaaacctaaacgccttattttcttctgcaacactgcttggctccaatacaaacttgacaatggctctaaatggccagaaaatggcactttcgatttctccatcctacaagatctaaataattcttgtcttaaaataggcaaatggtctgaggtgcctgatgtccaggcattcttttacacatcagtcccttcctagtctctgtgcccagtgcaacttgtcccaaatcttccttgtttccctcccgcctgtcccctcagtcccaaccccaagcatcgctgagtctttctaatcttccttttctacagacccatctgacctctcccctccttgccaggccaagctaggtcccaattcttcctcagcctccactcctccaccctgtaatctttttatcgcctcacctcctcacacctggtccggcttacagtttcgttccatcactagcccttccccacctgcccagcaatttactcttaaaaaggtgcctggagccaaaggcatagtcaaggttaatgctcctttttctttatcccaaatcagaagcgtttaggctctttttcatcaaatataaaaacccagcccagttcatggctcattcggcagcaaccctgagacgctttacagccctagaccctaaaaggtcaaaaggccatcttattctcaatatacattttattacccaatctgctcccgacattaaataaaactccaaaaattagaatctggccctcacaccccacaacaggacttaattaacctcaccttcaaggtgtacaatgataaaaaaaaaaagttgcaattccctgcctccactgtgagacaaaccccagccacatccccagcacacaagaacttccaaacacctgaaccgcagtggccaggcgttcctccagaacctcctccccgaggagcttgctacaagtgccagaaatctgaccaccaggccaaggaatgcctgcagcccaggattcccccatctgtgtgggaccccactggaaatcagactgttcaactcacctggcagccactcccagagcccctggaactctggcccaaggctctctgactgactccttcttggcttagcggctgaagactgacacagcctgatcgcctcggaagccccatagaccatcacagatgccgagctttaggtaactctcacagtggagggtaagtccatccccttcttaatcaatacagaggctacccactccacattaccttcttttcaagagcctgtttcccttgcctccataactgttgtgggtattgatgcccaggcttctaaacctcttaaaactccccaactctggtgccaacttagacaatactcttttatgcactcttttttagttatccccacctgcccagttcccttattaggccgagatattttaaccaaattatctgcttccctgactattcctggactatagccgcatctcattgctgcccttcttcccaatccaaagcctcctttgcgtcctcttcttgtattcccccaccttaacccacaagtataagatacctctactccctccttggcgaccaatcatgctccccttaccatctcgttaaaacctaatcacccttaccctgctcaatgccaagatcccatcccacagcacgctttaaaaggattaaagcctgttatcactcgcctgctaaggcatggccttttaaagcctataaactctccttaccattcccccattttacctgtcctaaaaccagacaagccttacaagttagttcagaatctgcaccttatcaaccaaattgttttgcctatccaccccgtggggccaaacccatataacctcctatcctcaatacctccctctactacccattattctgttctggatctcaaacatgctttctttactattcctttgcacccttcatcccagcctctctttgctttcacttagactgaccctgacacccattaggctcagcaaattacctgggctgtactgccacaaggtttcacagacagcccccattacttcagtcaagcccaaatttcatcgtcatctgttacctatctcggcataattctcataaaaacacacgtgctctccctgctgatcctgtccgattaatctcccaaacctcaatcccttacaaaacaacaactcctttccttcctaggcatggttagtgcagtcagaattcttacacaagagccaggactgcaccctgtagcctttctgtccaaacaacttgatcttactgttttagcctagccctcatgtctgcatgcagcagctgccactgctttaatacttttagaggccctaaaaatcacaaactatgctcaactcactctctacatttctcataacttccaaaatctattttcttcctcatacctgatgcatatactttctgctccttggctccttcagctgtactcactctttgttaagtctcccacaattaccatcattcctggcccggacttcagtccagcctcccacattattccagaaaccacacctgaccctcatgactgtatctctctgatccacctgacattcaccccatttccccatatctccttctttcctgttcctcaccctgatcatgcttgatttattgatggcagttccaccaggcctaatcaccacacaccagcaaaggcaggctatgctatagtacaagccactagcctgcctcttagaacctctcatttcctttccattgtagaaatctatcctcaaggaaatcacttctcagtgttccatctgctattctatgtgctattctactactcctcaaggattattcaggccccctcccttccctacacatcaagctcgaggatttgcccctgcccaggactggcaaattagctttactcaacatgccctgagtcacaaaaactaaaatacctcttagtctaagtagacactttcactagataggtagaggcctttcctacagggtctgagaagggcaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttatagtcctctgtcttcaagaaaagtagaacggactaaaggtcttttaaaaacacacctcaccaagctcagccaccaacttaaaaagaactggacaatactttcaccactttcccttctcagaagtcagacctgtcctcggaatgctataaggtacagcccatttaagttcctgtatagatgctccttttcattaggcccccagtctcattccagacaccggaccaccttagactgtgccccaaaaaaacttgtcatccctactattttctatctagtcatactcctgttctctgttctcaactactcatacatgccctgctcttgtttacactgccagtttacactgttttttcaagccatcacagctgatatctcctcgtgctatccccaaaccgccgctcttaactcttgaagtaaataaataatctttgctggcaggactatgctgaatctccttaggcactctctaatcagatgtcctaggtcctcccgattcttagaccttttatacctgtttttctccttctcttattccatttagtttttcaattcatacaaaaccatatccaggccatcaccaatcattctatacgacaaatgtttcttctaacatccccacaatatcaccccttaccacaagacctcccttcagcttaatctctcccactctaggttcccacgccgcccctaatcccgcttgaagcagccctgggaaacatcgcccattctctctccataccaccctccaaaaattttcgccaccccaacacttcaacactattttgttttatttttcttattaatataagaaggcaggaatgtcaggcctctgagcccaagccaagctatcccatcccctgtgacttgcacatatacgcccagatggcctgaagtaactgaagaatcacaaaagaagtgaatatgccctgccccaccttaactgatgacattccaccacaaaagcagtgaaaatggccggtccttgccttaagtgatgacattaccttgtgaaagtccttttcctagctcatcctggctcaaaaatcacccccactgagcaccttgcgacccccactcctgcccgccagagaacaaaccccctttgactgtaattttcctctacctacccaaatcctataaaacggccccacccttatctcccttcgctgactctcttttcggactcagcccgcctgcacccaggtgaaataaacagccatgttgctcacacaaagcctgtttggtggtctcttcacacggacacgcataaaagcaagtagccaccatagtggacagtacaggcctagtgtccagcatgatgcctgacaaatgaaagatgcttaataaactcttcttaagtgtatgaaaggatggagtagaataatttttactctgctttgcactgtccagactacacatctgaaatattatgttctgttccaggcaccaaattttaagagggttagtatcaacctagactatagaaggaagtaggatgataacagtcccaaaacatcagccatagttggcagaacttggaatgttttgtatgaaaaataatagcctttgcatgaaatcaaactaaatgcccatcaatgacagattggataaagaaaatgtggtacatatacacatggaatactatgcagccataaaaaaacagatagtgtcttttgcaggaacatggatggagctagaagctattatccttagcaaactaatgcagggaaaaaaccaaatacgacatgttctgacttataagtgggagctaaatgatgagaactcatgaacacaaagaagagaacaacagacacaggggtctacttgagagtgggaggagggagaggagcagaaaaacaagtattggctactaggcttaatacctgggtgatgaaataatctgtacaacaaacccccatggcacgagtttacctacgtaacaaagcttcacatgtacccccaaacctaaaataaaagttaaaaaaaaggaaaataatcatatttggattcattttaggttttgttttgttttgttttgtttttgtatgcctttggtctggatcaaagtttttttttttaattaaagggttggattaggcaatgttttaggcccacgtaagatagaaaagtctatgatacgatagttcttcctgtagaagaggaagtagactctcatagagcagaaatttgatgaccttggaggatactagatacatccacacatggggaagaactttctgagaacagtgcaggaacggaatgagggagccagtgagcttcttccctggaaatacacaagaagagcctctcaaagttcaaatcatgaatgaatgcagtcttctttccagccacaaacatttcccagaattggtattttagggcagcacatggatttccagagcttccaatcattaataatagttactaatgcaaaagttacacctcatgcttgtgtctttcagaattgtgtctgagtgcggtcagttcatcttaagtgacagggtttcgcccaccagccaaatgattttggattattgaaggagttggtcatgaagaatatgttttcacaaggaaagtatgcatatacattccaaataacatggttgtgggatagtcaccatgaccagaatttcagctttctgggacccagtgcttccacctccaactgtgctatggagagagagccactgcctttccaggtaccatgtatgttataattgacagtgtcaggcctctgagcccaagccaagccatcacatcccctgtgacttgcacatatatgcccagatggcctgaagtaactgaagaatcacaaaagaagtgaaaatgccctgccccgccttaactgatgacattccaccacaaaagaagtgaaaatggctggtccttgccttaagtgatgacattaccttgtgaaagtcccttttcctggctcatcctggctcaaaaagctcccccactgagcaccttgtgacccccactcctgcccgccagagaacaagtcccctttgactgtaattttcctttatctacccaaatcctataaaacggccccacccttatctcccttcgctgactcttttcggactcagcctgcctgcacccaggtgattaaaaagctttattgctcacacaaagcctgtttggtggtctcttcacacggacgcgcatgaaa

SEQ ID NO: 254 - DNA, 7162 bp, Homo sapiens
gcaaccccctttgggacccctccctttgtatgggagctctgttttcactctatttcactctattaaatcttgcaactgcactcttctggtccgtgtttgttacggctcgagctgagctttcactcaccgtccaccactgctgtttgccaccatcgcagacccgccgctgacttccattcctccagatccggcagagtatctgctgtgctcctgatccagtgaggcgcccattgccacttccaatcaggctaaaggctcgccattgttcctgcatggctaagtgcctgggttcatcctaatcgagctaaacactagtcactggcttccatggttctctcccatgacccacagcttctaatagagctataacactcaccgcatggcccaagattccattccttggaattcgtgaggccaagaaccccaggtcagagaacacgaggcttgccgccatcttggaagtggctcaccaccatcttgggagctctgggagcaaggaccccccaccccccgtaacattttggcaaccacgaagggacatccaaagcagtgagtaatattggaccactttcgcttgctatactgtcctagccttccttagaggtggaggaaaataccggacacctgtcggccagttaaaaacgattagcgtggccgcctgacttaagactcaggtgtgaggctatctggggaagggctttctaacaacccccaacccttctggggttgttggggacattggtctgcctggagccagcttccactttcaattttcttggggaaaccaagggccaactagaggcagaaagctgtcgtcccaacctcccagcagtagctgattgagatcatggctcagccagaagtctctactcaacagtcgcccacgcatgcgcccttacctttccttctgacccatacctcctgggtcccgaacacgactttcttgaaagtatagccccaaaattctccttacctctgaatctacttcctctgatccctgcctcctaggtactaatggttcagactttcatttcctctagcaggttgtatctccaaagggatctaaggaagccctacgctgcgtcctcaggcacctaggctatagcccagggagtcttatccctggcgtccctcctaatttaggtatacagctcttgacatgagcagttatgcaggacccattccccaccacccttgccagggccccaagtttgtaatggctaagagagagacacggagagagagagatggagagagagagagagagatgaagagagagagagagacagagaggcaggttcttggcctcacggattccaaggaagtcaaagagtaaaagaaagaaaaagaaatagttaaaaaaaaaaaagtgtgccctattcctttaaaagccagggtaaatttgaaacccataattgataattgaagatcttctctatgaacctataacactccaatgccactttgttgtcagtgtaaataagggcgtagcccgaaagcactgaggccactgacaacccatagccttcctgtctaaaatccttaacccagtaacccacggatgagccaaatgcattcagttggtagcggcaactgctttgctaaaagtagaaaagtaacttttagaggaaacttcgctgtgagcacacctcaccagttcagaattagtctaagtcaaaaaagcaaagaggtagcttactaactcaaaaatcttaaagtatggggccattatgttagaaaaaagtaatgtaactccaaccgctgataattcccttaacccagcagattttctaacaggggatttacatcttaattaccatacaaaggtccgaccagacctaggaggatcttccttcaggacaggatgatagatggttcctcccaggtgattgaggtaaaaaacacaatgggtattcagtaattgatacggagactcttgtggaagcagagttagaaaaattgcctaataattggtctcctcaaatgtgcgagctgtttgcactcagccaagccttaaagtacttacagaatcaaaagactatctcaatcctgactcaaaaggttcgctacaccctctctgaaacgaatttgcataaaaactgttgtttatgggaatgcatcttgatggggcagctgggttgttatgaaatactcaggaacccagcccagctctaggactcactcctgagcgcaaaggcaatgttgggcacgctggtaaaggaccactagaatccagcagcccggacccctttctttgtggtcaagaaaggcgggaaaacaggtgcaggactgctacatcggtgagtgtaactaatccgataagcagaggtccatgggtggttacgcaccctggaaaggaataagcattaggaccacagaggacactctaggactaatgctcatcagaaaatgactagggatgctggcatccctatgttcctttttcagatgggaaacgttccccccaaggcaaaattgcccctaagatgtattctggagaattaggaccaatttgaccctcagacgctaagaaagaaatgacttatattcttctgcagtaccgcctggccgtgatattctcttcaaggggaagaaagctggcctcctgagggaagtataaattataacaccatcttacagctagacctcttttgtagaaaagaaggcaaatggagtgaagtgccatatgtacaaactttcttttcattaagagacaactcgcagttatgcaaaaagtatgacttatgccctacaggaagccctcagaatctacctccctaccccaacatccccctgactccttccccaactaataagaaccccctcttcagcccaaatggtccaaaaggagatagacaaaggggtaaacaatgaaccaaagagtgccaatattccccgattatgccccctccaagcagcgggaggaggagaattcagcccagccagagtgcatgtaactttttctctctcagacttaaagcaaattaaaatagacctaggtaaattctcagataaccctgatggctatattgatgttttacaagggttaggacaatcctttgatctgacatggagagatataatgttactgctaaatcagacactaaccccaaatgaaaaagtgccaccattactgcagcctgagagtttggcgatctctggtatctcagtcaggtcaatgacaggatgacaacagaagaaagagaatgattccccacagggcagcaggcagtccccagtgtagaccctcactggcacacagaatcagaacatggagattggtgccgcagacatttgctcacgtgtgtgctagaaggactaaggaaaactaggaagaaggctgtgaattattcaatgatgtacactatagcatagggaaaggaagaaaatcctactgcctttctggagagactaagggaggcattgaggaagcatacctccctgtcacctgactctagtgaaggccaactaatcttaaaggataagtttatcactcagtcagctgcagacattaggaaaaaacttcaaaagtctgtcttaggcctggagcaaaacttagaaaccctattgaacttggcaacctcgcttttttataatagagatcaggaggagcaggcagaacaggacaaacaggataaaaaaaaggccatcactttagtcatggccctcaggcaagtggactttggaggctctgtaaaagggaaaagctgggcaaatcgaatgcctaatagggcttacttccagtgcggtctacaaggacactttaaaaaagattgtccaagtagaagtaagccgccctcttgtccatgccccttatgtcaagggaatcactggaaggcccactgccccaggggatgaaggtcctctgagtcagaagacactaaccagatgatccagcagcagggctgagggtgcccagggcaagcgccagcccatgccatcaccctcacagagccccaggtatgcttgaccattgagagccaagaggttaactgtctcctggacgccggtgcggccttctcagtcttactctcctgtcccggacaactgtcctccagatctgtcactatccgaggggtcctaggacagccagtcactagatacttcttccagccactaagttgtgactggggagctttacccttttcacatgctttcctaattatgcctgaaagcctcactcccttgttagagagagagattctagtaaaagcaggggccattatacacctgaacataggagaaggaacacccatttgtcgtctcctgtttgaggaaggaattagtcctgaagtctgggcaacagaaggacaatatggacaagcaaagaatgcccattttgtccaagttaaactaaaggattccacctcctttccctatcaaaggcagtaccccctcagacccgaggcccaacaaagactccaaaagattgttaaggacctaaaagcccaaggcctagtaaaaccatacagtagcccctgcaatactccaattttaggagtacagaaacccaaaagacagtggaggttagtgcaagatctcaggattatcaatgaggctgtttttcctctatacccagctatacctagcccttatactctgctttcccaaataccagaggaagcagagtggtttacagtcctggatcttaaggatgcctttttctgcatccctgtacatcctgactctcaattcttgtttgcatttgaagatccttcaaacccaacatctcaactcacctggactgttttaccccaagggttcagggatagtccccatctatttggccaggcattagcccaagacttgagccagttctcatacctggacactcctgtccttcagtgcatggatgatttacttttagctgcccgttcagaaaccttgtgccatcaagccacccaagcgctcttaaatttcctcactacctgtggctacaaggtttccaaaccaaaggctcagctctgctcacagcaggttaaatgcttagggctaaaattatccaaagtcaccagggccctcagtgaggaacgtatccagcctatactggcttatccttatcccaaaaccctaaagcaactaagagggttccttggcataacaggtttctgccgaatatggattcccaggtacggcaaaatagccagaccgttatatacgctaattaaggaaactcagaaagccaatacccatttagtaagatggacacctgaagcagaagcagctttccatgccctaaagaaggccctaatgcaagccccagtgctaagcttgctaacggggcaagacttttcctcatatgtcacaaaaaacaaacaaacaaagaaaaaaaaaaacatgaatagctctaagagtccttgcgctggtctgagggacgagtttgcaacccgtggcatacctgagtaaggaaattgatgtagtggcaaagggtcagcctcattgtttacgggtagtggtggcagtagcagtcttagtatctgaagcagttaaaataatacagggaagaaatcttactgtgtggacatctcatgatgtgaatggcatactcactgctaaaggagacttgtggctgtcagacaaccatttacttaaatatcaggctctattacttgaagggccaatgctgcgactgtgcacttgtgcagctcttaacctggacacatttcttccacacaatgaagaaaagatagaacataactgtcaacaagtaattgctcaaacctatgccactcgaggggaccatttagaggttcccttgactgatcccaaccctaacttgtatactgatggaagatcctttgtagaaaaaggacttcaaaaagtggggtatgcagtagtcagtgataatggaatacttgaaagtaatcccctcactccaggaactagtgctcagctggcaaaactcactcgggcactagaattaggagaaggaaaaagggtaaatatatatacagactctaagtatgcttacctagtcctccatgcccatgcagtaatatggagagaaagggaattcctaacttctgagggaacacctatcaaacatcaggaagccattagggaattattattggccgtacagaaacctaaagaggtggcagtcttacactgccggggtcatcagaaaggaaaggaaagggaaatagaaaggaaccgccaagcagatattgaagccaaaagagctgcaaggcaggaccctccattagaaatgcttatagaaggacccctagtatggggtaatcccctctgggaaaccaagccccagtattcagaagaagaaatagaatggggaatctcacgaggacatagttttctcccctcaggatggcaagccaccgaacaaggaaaaatacctttgcctgcagctaaccaatggaaattacttaaaaccactcaccaaaactttcacttatgcattgatagcacccatcagatggccaaattgttatttactggaccaggacttttcaaaactctcaagcagatagttggggcctgtaaagtgtgccaaagaagtatccccaggccatacatttgaatccctgtatctttaacctccttgttaagtttgtctcttccagaattaaagctgtaaaactacaaatcattcttcaaatggagccccagatgcagtccatgactaagatctaccgcggacccctggaccaccctgacagcccatgctccaatgttaacgacatcgaaggcacccctcctgaggaaatctcaactgcacaacccctactacaccccaggccagcaggaagcagttagagcagtcatcgccaacctccccaacagcacttgggttttcctgttgagagagaggactgacagacaggactagctggatttcctaggctgactaagaatccctaagcctagctgggaaggtgaccacttccacctttaaacaaggggcttgcaacttagctcacacccaaccagatagtaaggagagctcactaaaatgctaattaggcaaaaacggagataaagaaataaccaatcatctgttgcctgagagaacagtgagagggacaatgattgggatataaacccaggcattcgagccagcaacggcaaccccctttgggtctcctccttttgtatgggagctctattttcactctatttcactctattaaatctttcaactgca

SEQ ID NO: 255 - DNA, 1620 bp, Homo sapiens
gtcaggcctctgagcccaaaccaagccatcgcatcccctgtgacttgcacgtatacacccagatggcctgaagtaactgaagatccacaaaagaagtaaaaatagccttaactgatgacattccaccattgatttgttcctgtcccaccctaactgatcaatgtactttgtaatctcccccacccttaagaaagttctttgtaattctccccacccttgagaatgtactttgtgagatccacccctgcccgcaaaacattgctctcaacttcaccgcctatcccaaaacctataagaattaatgataatccatctcccttcgctgactctcttttcggcacccaggtgaaataaatacccatgttgctcacacaaagcctgtttggtggcctcttcacacggacgcacatgaaaccagctacttgggaggctgaggcaggagaattgcttgaacccgggaggcggaggttgcggtgacccgagatcacgccattgcactcctgcctgggcaacaagagcaaaattccgtctcagggaaaaaaaaaaaattagctgggtgtggtggggcaggcctgtaatcccagctactcaggaggctgaggcaggagaatcacttgaacctgggaggcggaggttgcagagtcgagatcatgccattgccctccagcctgggcgactgagtgagactccatcttaaaaaaaaaaaaaaaaaaagtcttttattactttttgagcatttaaagagtattttttggccagacggtgtggctcacgcctgtaatcccagtattttgggaggcccaggcgggtggatcacttgaagcctccagcctggccaacatggcaggagaatgactggaacccgggaggtggatgttgcagtgagccaagatggtgtcactgcactccagcctgggtgacagagagagactctgtctcaaagacaaaaagaaaatttgttcagtattttcttcaatcagctttctcagactgaatgttcacccttttaaatattcataatgttcctgagaatccatttggctattctgttttcttcacccttctccagccttcccctcctcaattcgacccatttcttccctacttcccaaaagaaaaaatatctactttggattaatataaatcagtttaatctaacttattcaagacttttttggcctctacttggaggttcaagaaaaggtgtgtcaggcctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccctgtgacccccactctgtccgccagagaacaacacccctttgactgtaattttcctttatctacccaaatcctataaaacagccgcacccttatcttccttcgctgactctctttttggactcagcccgcctgcacccaggtgaaataaacagccatgttgctcacacaaagcctgtttggtggtctcttcacacgcacgagcatgaaa

SEQ ID NO: 256 - DNA, 684 bp, Homo sapiens
ttacagtaggtagctggtcaggcatgagcagggcaggagagggccccttgccctcccccaggaatatcaggcaaccagcaggtgatggtcagatggttgttaactgtcactctaaaataataattggttgcaactggcaccaggaaggggcagcctcccaatagacagaaaaaacctgaaatgcgatcagcagcttcccaataaaatctcaggagtagggcgagtgggctcacatatgtgcactgaaggcaaaaatggcggcatttaactggcctatgacctaggaacctttggtaagggaagaatgcctcaagtgagcatgcatacaactccagtaaacacactgcacgtgtgaccccttcgaagcgctgacaggccactgcgcacttggacagcccacctcaagggaagaatcagagaagggatgcaagaccccagaagcacacaaatgtataaaatcccaagtcaaaggtgaaactgcacttgatctctcaagtcacccacttgaccctcttccaagtgtactttacttccttgcattcctgctctaaagctttttaataagctttcactcctgctctaaaacttgcctcagtctcacactctgccttctgtcacttagtcgaattatttcatctgaggaggcaagaactgaggttgctgcagacccttatggattcacca

SEQ ID NO: 257 - DNA, 759 bp, Homo sapiens
gagagacaggactagctggatttcctaggccaactaagaattcctaagcctagctggggaaggagaccgcacccatctttaaacaccgggcttgtaagtcagctcacacccgacctatcaggtagtaaagagggctcactaaaataccaattaggctaaaagcaggaggtaaagaaatagtcaaatcatctatcgcctgagagcacagtgggagggacaatgattgggatataaagccaggcatttctagcctgcagtggcaagcccctttgggtcccttcccgttgcatgggagctctgttttcactctattaaatcttgcaactgcacactcttccggtctgtgtttgttctggctggagctgagcttttgctcgccgtccaccactgctgagcactgttgtcgcagacctgtctttgatttccacccctccggatccggcagggtgtccacttctgatccagcgaggcgcccactgctgctcccgatcagggctaaaggctcgccattgttccctcatggctaagtgcccaggttattcctaattgagctgaacactagtcgctgggttccacagttcctttccatgacccacagcttctaatagagctataacactcactgcatggcccgaggttccattccttgaaatctgtgaggccaagaaccccaggtcagagaacaaaaggcttgctcccatcttgggagtagccggccctcatcttgggagcgctaagaacaaagacccccagataaca

SEQ ID NO: 258 - DNA, 76 bp, Homo sapiens
ttagagtaggtagctacccaggcatgagcagagcaggggaaggctcccccacaccaggaatgtcaggtgaccataa

SEQ ID NO: 259 - DNA, 3299 bp, Homo sapiens
tttctggtagagacataggaaacgtgttttatccgtggacccaaaactccagcgctggtcatggacttgggaagacagtcccaagtctttccattttttcctcagcctccgccccgccaccctacaatccttttatcacctccccctcctcacacctggtccagcttacagtttcgttctgcgactggccctcccccacctgcccagcaatttcctcttaaaaaggtggctggagctaaaggcatagtaaaggttaatgctcctttttctttatcggacctctcccaaatcagttagcgtttaggctctttttcatcaaatatgaaaaacccagcccagttcatggcccatttagcagcaacccttaagactctttacagccctagaccctgaagggtcagaaggccatctcattctaattatgcattttaacacccagtcagctcctgacattaaataaaactcctaaaattaaattccggccctcaaaccccacaacaggacttaattaacctctccttcaaggtgtacaataataaagtagaggcagccaagtagcaatgtatttctgagttgcaattccttgcctccactgtgagaaaaaccccagccacatctccagcacacaagaactccaaacacctgaactgcagctgccaggggttcctccagaacctcctcccccaggaacttgcttcaggtgccggaaatctggccactgggcgaaggaatgcctgaagcccgggattcctcctaagccttgtcccatctgtgcgggaccccactggaaatccaactcgcccagcagccactcccagagcccctggaactccggcccaaggctctctgactgactccttcccagatcttctcagcttcgtggctaaagactgatgctgcccgatcaccacagaagcctcctggaccatcacagatgctttaggtaactcttaaagtggagggtaagtccatccccttcttaatcaatacagaggctaccaactccacattaccttcttttcaagggcctgtttcctttgcctccataactgttgtgggtattgaagaccacgcttctaaaacctcttacactccccaactctggtgccaacttggacaatactcttttaagcactcctttttagttatccccacctgcccagctccctgaataggtcaaaacattttaactaaattatttgcttccctgactattcctgggctacagccacacctcattgttgccttttcccccagttcaaagcctccttcacacatcctccccttgtatctccccaccttaaaccgtagtatagtatacctctactccctccttggcaaccgatcatgcacctcttaccatcccattaaaacctagtcacccttaccccacttaatgccaatatcccatcccacagcacgctttaaaaggattaaagcctgttatcactcacctgttacagcatggacttttaaagcctataaactctccttacaattcccccattttacctgtccaaaaaccagacaagtcttacaggttagttcaggatctgcatcttatcaaccaaattgttttgcctatctaccccgtggtgccaaacccatatactctcctatcctcaatacctcccctccacaacccattattctgttctggatctcaaacatgctttctttactagtcctttgcacccttcatcccagcctctcttcgctttcacttggactgaccctaacacccatcaggctcagcaaattacctgggctgtactgccacaaggcttcacagacagcccccatcacctcagtcaagccagtgttcttacacaagagctgggaccgcgccctgtagcctttttatccaaacaatttgaccttactgttttagcctagccctcctgtctgcatgtggcggctaccgctgccttaatactttcagaggctttcaaaatcacaaactatgctcaactcactctctacagttctcataacttccaaaatctattttctttctcacacctgatgcatatactttctgcccaccccactacctctcagcaagccaaactcattgccttaacttgagccctcactcttccaaaaggactacacatcaatatttatactgactctaaatatgccttccatatcctgcaccaccatgctgttatataggcaaaaaaaaaaaaaaattcctcactatgcaagggtcctccatcactaatacctctttaataaaaactcttctcaaagccgctttacttctgaaggaagctggggtcattcactgcaagggccatcaaaaggcatcagatcccattgctcaggacaacgcttatgctgataaggtagctaaaaaagcagccatcaaaaagtatcagatcccatcgcccaggacaatgcttatgctaatagggcaactaaaaaaagcagccagcgttccaacttctatctcacagagcagtttttctccttctcatctggccactcccacctactcccccactgaaacttccacctatcaatctcttcccacacaaggcaagggtttttggaccaaggaaaatatatccttccagcctcacaggcccactctattctgtcgtcttttaatacctgtttttctcctcttattctgtttagtttttcaattcatacaaaaccatatccaggccatcaccaataattctatacgacaaatgctccttcaaacaaccccacaatatcacctcttaccacaaaatcttccttcagcttaatctctcccactctaggttcccatgccgctcctaatcccgccctgagaaacatcgcccattatctatccataccagccccaaaaattttcgctaccccaacactttaccactatttcgttttatttttcttattaatataagactacaggaatgttaggcctctgagcccaagctaagccatcatatgccctgtgacctgcacatatatatccggatggcctgaagtaactgaagaatcacaaaagaagtgaaaatagcctgttcctgccttaactgatgacattaccttgtgaaattccttctcctggctcatcctggctcgaaagctcccccaatgaacaccttgtgacccccaccaaagaacaacccgctttgactaattttcctttacctacccaaatcctataaaatggccccacccctttctccctttgctgactcttttcggactcagaccgcctgcacccaggtgattaaaaagctttattgctcacacaaagcctgttccgtggtctcttcacagggacatgagtgaaa

SEQ ID NO: 260 - DNA, 662 bp, Homo sapiens
ttacagtaggtaactagtcagacatgagcagggcaggagaaagctcccactactcccacacacaccaaaaatgttacaccactatcacgtgatgatcaggaagttgttagctgtctctctaaaataataattgatcacagctggtgccagggaaaggcagactcccaatagatagaaacactgaatctggtgatcagcagcttcccaacaagatctcaggagttgggtgagtgggctgaagcatgtgcattaagaggcaaatggtagagtttaactggtatatgactttctaggatccttctatcggaaagagaagaacaccttaagtgagcatgcatccaactccaataaacacactgcacatgctcatttcccaagtgctagcaggtcactgcacatgtggacagcccaacccaagagaagaatcagtggagaagggacacaagaccccagaagaatgccaacgtacaaaactccaagtcaaaaggtcaaaccacacacctgatctccgaagttgcccagttggcctgcttcttacttcctttcattcctgctttaaaacttgcctcggtctctccttctgccttatgcccctcagtcaaattctttcttctgaggaggtgaaaattgaggctgctgctggcccatatggatttgccagt

SEQ ID NO: 261 - DNA, 4163 bp, Homo sapiens
cttctcccttagcctgtgttctcaagaatttaaaacctcttcatctcacacctgacctaaaacctaaatgccttattgtcttctgcaatgccgcttgaccccaatacaaacttaacaatggttccaaatagccagaaaatggcactttcaatttttccatcctacaagatctaaataattattgccgtaaaatgggtaaacggtctgtggtgcctgatatccaggcattcttttacacatcagtccctctctagtctctgttcccaatgcgattcctcccaaatcctccttctttccctcccgcctgtcccctcagtcccaaccccaagtgtcgccgagtctttctaatcttccttttctacagacccatctgacctctcccctccttgccaggccaagctaggtcccaattcttcctcagcctctgctcctccaccctataatccttttatcacctcccctcctcacaccgggtctggcttacagtttcgttccgtgactagccctcccccacctgcccagcaatttactcttaagaaggtggctggagctaaaggcatagtcaaggttaatgctcctttttttttttatcccaaatcagatagcatttaggctctttttcatcaaatataaaaatccagcccagttcatggctcatttggcagcaaccctgagacgctttacagccctagaccctaaaaggtcaaaaggccgtcttattttcaatatacattttattatccaatctgcgcccgacattaaataaaactccaaaaattaaattccagccctcaaaccccacaacaggacttaattaacctcgccttcgaggtgtacaataatagaggcagccaagtagcaacatatttctgagttgcaattccttgcctccactgtgagacaaacccgagccacatctccagcacacaagaacttccaaacgcctgaaccgcagcagccaggcattcctccagaacctcctcccccagtagcttgctacaagtgccagaaatctggccaccgggccaaggaatgcccacagcccgggattcctcctaagccacatcccatctgtgcaggaccccactgaaaatcggactgttcaactcacctggcagccactttcagagcccctggaactccggcccaactctctctgactccttcccagatcttctcagcttagcggctgaagactgacactgcccaatcgtctcggaagctcctagaccaacaccgacaccgagctttaggtaactctcacagtgaagggtaagtccatccccttcttaatcaatacgaaggctacccactccacattaccttcttttcaacagcctgtctctcttgcctccataactgttgtgggtattgaaggccaggcttctaaacctcttaaaactccccaactctggtgccaacttagacaatactcttttaagcactcctttttagttatccccacctgtccagtttccttattaggctgagacactttaactaaattatctgcttccctgactattcctggactacagccacatctcattgccgcacttcttcccaatccaaagcctcctttgcgtcttcctctcatatccccccatcttaacccacaagtatgggacatctctactccttccctggcaacagatcacatgcccattaccatcccattaaaacctaatcacccttaccctgctcaacgccaatatcccatcccacagcacgctttaaaaggattaaagcctgttatcactcacctgttacagcatgggcttctaaaacctataaactctccttacagttcccccattttacctgtccaaaaaccggacaagtcttacagattagttcaggatatgcgccttatcaaccaaattgttttgcctatcaaccctgtggtgcccaacctgtacattcttttgttctcaatacctccctccacaactcactattccattcttgatcttaaagatgcttttttcacaattccactgcacccctcatcccagcctctctttgctttcagactgaccatgacacccatcagtcccagcagcttacctgggctgtgctgctgcaaggtttcatggacagccctcattacttcagccaagctgtttctcgtgatttactttctttccacccctctgcttctcaccttattcaatatattgatgaccttcttctttgtagcccctcctttgaatcttctcaacaagacatacttctgctccttcagcatttattctccaaaggatatcaggtatccccctccaaagctcaaatttcttctccatccattacctacctcagcataattctacataaaaacacaagtgctctcaaaccccaaccccttctacaaaaaaacaactcctttccttcctgggcatggttggatactttcgcctttggatacctggttttgccatcctaacaaaaccattatataaactcacgaaaggaaacctagctgaccccatagatcctaaatcctttccccactcctctttgcattccttgaagacagctttagagactgcccccgccctagctctccctgactcatcccaacccttttcattacacacagctgaagtgcagagctgtgcattctaacacaaggaccaggattgtgtcctgtagcctttctgtccaaacaacttgaccttactgttttagcctagccctcatatctgcgtgcagtggctgccgctgctttaatacttttacaggccctcaaaatcacaaactatgctcaactcactctctacagctctcataacttccaaaagctattttcttcctcacacctgatacatatactttctgatccccagctccttcagctgtactcactctttgttaagtcccacaattaccatttgcccaggactggcaaattagctttactcaacatgcaccgagtcagaaaacaaaaatacctcttagtctaagtagacattttcactggataagtagaggtctttcctacaaggtctgagaaggccaccacagtcatttcttcccttctgtcagacataattcctcggtttagccttttaccaccttcccttctcagaattctgacctgtccttggaatgctacaaggtacagcccatttaagctcctgtatagacactcttttttattaagccccagtctcattccagacaccagaccaacttggactgtgccccaaaaaacttgtcatccctactatcttctgtctagtcatactcctattcactgttctcaactactcatatatgccctgctcttgcttacactgccagtttacactgtttctccaacccatcacagctgatatctcctggtgctatccccaaactgccactcttaaatcatctttgctggcaggactatgctgaatctccttaggcactctctaattagatgtcctgggtcctcccaattcttagatctttaatacctgtttttctccttattccgtttagtttttcagttcatacaaaaccatatcttctaacagtcccacaatatcaccccttaccacagaatcttccttcagtttaatctcttccactctaggttcccatgccacccctaatcctgcttgaagcagccctgagaaacatcgcccattatctctccatagcatcccccaaaatttttgccatcccaacactttaccactatttcgttttgtttttcttattaatataagaagacaggaatgtcaggcctctgagcccaagctaagccatcatatcccctgtgacctgcacgtacacattcagatggccagttcctgccttaactgatgacattccaccacaaaagaagtgaaaatggcctgttcctgccttaactgatgacattgtcttgtgaaattccttctcctggctcatcctggctcaaaacctcccctactgagcaccttgtgacccctactcctgctcgacagagaacaacccccctttgactgtaattttcctttacctacccaaatcttataaaacggccccacccctgtctgtctttgctgactctctttgctgactctctttgctgactctcttttcggactcagcctgcctgcacccaggtgattaaaagctttattgctcacacaaagcctgtttggtggtctcttcacacggacacgtatgaa

SEQ ID NO: 262 - DNA, 962 bp, Homo sapiens
gtggggaaaagaaagagaagtcagactgttactgtgtctatgtagaaagaagtagacataagagactccattttgctctgtactaagaaaaattcttctgccttgagatgctgtttatctgtaaccctacccccaaccctgtgctccccgaaacaagtgctgtgtcgactcaacgtttaatggatttagggctatgcaggatgtgctttgttaaacaaatgcttgaaggcagcgtgctgttaaaagtcatcaccactccctaatctcaagtacccagggaaataaaacaccacggaaggcggcagggacctctgcctaggaaagccaggtattgtccgaggtttctccccatgtgatagtctgaaatgtggccttgtgggaagggaaagacctgatcgtcccccagcctgacacccataaatggtctgtgctgaggaggattagtaaaagaggaaggcctctttgcagttgagataagaggaaggcatctgtctcctgctcatccctgtcatccctgagcaatggaatgtctcggtgtaaaaccctatggtatattccatctactgagacaggagaaaaccaccttaggactggagttgagacatgctggtggcaatactgctctttaatgcattgagatgtttatgtatatgcacatcaaagcacagcacctttttctttaccttgtttatgatacagagacatttgttcacatgttttcctgctgaccctctccccactgttaccctattgtcctgccacatccccctctcagagatggtagagataataatcaataaatactgagggaactcagagaccatatgctgagcgcggatcccctgggcccacttttctttctctatactttgtctctgtatctctttcttttctcagtctctcgtacccccgccccccgacgagaaacgcccacaggtgtggaggggaagacctccccttca

SEQ ID NO: 263 - DNA, 993 bp, Homo sapiens
gagctcggctgttggagacgtgagtcttgctgaagctcctggccgaataaagcccttccttctttaactcggtgtctgaggggttttgcccgtggcttgttctgctacatttcttggttccctgaccgggaagcgaggtgattaacagacagtcggacggtcgaggcagccccttaggtggcttaggcctgccctgtggagcatccctatggggcactccagccagcttggccgatgcggatcctgagagcactcctgggtaggcaattggcctggtggaacgcctcgccagaggagcacgtggcaggcccccgtggacgatcaacgcagtggctgaacaccgggaaggaactggcacttggagtctggacatctgaaacttggtaagactagtctttggaacttgcccactccatttgagtggaagcgtggcctgatcacccacggtctgcctgtaccggcactttggtttttgtttttgacttgacttggattgcttgatactttggttttgtttttgacctggcttggatttctggatactctgattttggttttgattctgagtttggtgtaaactgtaaaagtgtgtgtgtgtgccctttttactcgttctttgttttgtggtgtgagcatggtgttttgtctcgaagaagcatgggtcaggcacaaagtaagcccaccccactaggaactatgttgaaaaatttcaaggaaggatttaagggagattatggtgttactatgacaccaggaaaacttagaactttgtgtgaaatagactggccagcattagaggtgggttggccatcagaaggaagcctggacaggtcccttgtttcaaaggtatggcacaaggtaacctgtaagccagggcacccagatgagttcccatacatagacccttggttacagctggttttagaccccacacccccctcaccagtggttgagagaacagcagcataagtggctggcagagacaaggaaaga

SEQ ID NO: 264 - DNA, 6158 bp, Homo sapiens
gtcaggcctctgagcccaagctaagccatcgtatccccagtgacctgcacatatacatccagatggcctgtttggtgttctcttcacatagacatgtgagacatttgatgccaaaacccaggacgggaggactccttcgggagaccggtcccctgtcctcgccctcactccgtgaggagatccacctatgacctcgggtcctcagaccaaccagaccaaggaacatctcaccaatttcaaatcaggtaagcagtcttttcactcttctctggcctctctcgctacccttcaatctccctgtcattccaattccagttctttttcctctctaatagagacaaaagagacacattttattcgtggacccaaaactccggcgctagtcatggacttgggaagacagccttcccttgatgtttaatcactgcggggacacctgcctgattattcacccacatttcattggtgtctgatcaccgcagggatgcctgccttggtcattcacccacattcccttggtggcaagtcaattgcggagacgcctgctttggctgctcacccacattgcagcccagggctgctctccacccccttctctgtgtctccacctttctctttaaactaacgtccttcactatgggcaaccttccgccctccattcccccttcttctcccttagcctgtgttctcaagaacttaaaacctcttcaactcgcacctgacctaaaacttaaatgccttattttcttctgcaatactgcttggccccaatacaaactcgacagtagttccaagtggccagagaatggcactttcgatctgtctatcctataagatctagatagtttttgtcgaaaaatgggcaaattcctacaagatctagataatttttgttgaaaaatgggaaatggtctgaggtgcctgacatccaggcattcttttacacattgctccctccctagtctctgctcccaatgcgacttgtcccaaatctttcttctttctcctgtctgttccctcagtcaccaccccaagctctgagtcctttgaatccttcttttctacagactcatctgacctctccccttctccccaggctgctcctcgccaggccaagccaggtcccaattcttcctcagccgctgctccccaaccctaggatctatctgtcacctcccctcctcacacccagtctggcttacagattcgttctgcaactagccctcccctacctgcccaacaatttcctcttaaaaaggtggctggagctaaaggcaagtcaaggtttctttatctgaccactcccaaatcagttagcatttaggttttttttcatcaaatataaaaacccagcccagttcatggcatgcttggcaacaacccttagacactttactgtcctagatccaggaggaaggctgtcttattctcaatatgcactttattacccagtccactcctgacattggaaaaagctccaaaaattagattccggccctcaaaccccataacaggaccttattaacctcgctttcaaggtgtacaataatagagtagatgcagccaagtagcaacgtatttctgagttgcaattacttgcctccactgtgagagaaaccccagccacatctctagcacacaagaacttcaaaacgtctgaaccgcagcggccaggcgttcctccaggaccgcctcccccaggatcttgctctaagtgctggaaatctggccactgggccaaggaatgcccgcagcccaggattcctcctaagccgtgtcccatctgtgtgggaccccattggaaattggactgtccaactcgcccggcagccactcccagagcccctggaactctggcccaaggctcgctgactgattccttcccagatcttctcagcttagtggctgaagactgatgctgcctgatcacctcagaagcctcccggaccatcacggacgctttgggtaactcttacagtggagggtaagtctgtccccttcttaatcaatacggaggctacccactccacattaccctcttttcaagggccagtttcccttgcctccataaccgttgtaggtattgacagccaggctgctaaacctcttaaaactccccaactctggtgccaacttggacaacattctttaatgtactccttttatttatccccacctgcccagctcttattaggatgagacattttaactaaattatctgcttctctgactattcctgggctacagccacacctcattgccgccttttcccccagttcaaagcctccctcacatcctttccttgtatctccccaccttaatccacaagtataggacacctctactcccgccttggcaacggatcatgcaccccttaccatcccattaaaacctaatcacccttaccccgctcaatgccaatatcccatctcacagcacgctttaaaaggattaaagcctgttatcacttgcctgttacagcatggccttttaaagcctataaactctccttacaattcccccattttagctgtccaaaaactggacaagtcttacaggttagttcaggatctgagccttatcaaccaaattatcttccctatccaccccgtggtgccaaacccatatactctcctatcctcaatacctccctccacaacccattctgttctagataaacctagctgaccccataaatcctaactcctttccccactcccctttccattccttaagaagcagccctaaaagctgttcccacactagctctccctaactcatccccacccttttcattacacacagccaaagtacagggctgtgcggtcagaattcttttttttttttttgagaagagtctcgccgtgtcacccaggctggagtgcagtggcacgatagtcagtattcttacacaagagccaggagtgcgccctgtagcctttctgtccaaacaacttgaccttactgttttcgcatagccctcatgtctgcatgtggcggctgctgctgctgctttaatacttttagaggccctcaaaatcacaaactatgctccacttactctctacagttctcataactttcaaaatctattttcctcctcacacttgaagtatatactttctgccccccagctccttcaggtatactcagtctttgttgagtctcccacacttaccattgttcctggcctggacttcaatccagcctcccacattattccagataccacacctgacccccatgactgtatctctctgatccacccgacattcacttcatttccccatatttctttctttcctgttccttaccctgatcacacttggtttattgatggcagctccaccaggcctaatcaccactcaccagcaaaggcaggctatgctatagtatcttccacatctatcattgaggctaccactctgcccccctccactacttctcagcaggctgaactcattgccttaactcgggccctctctcttgcaaagggactacacgtcaatatttatactgactctaaatatgccttccatatcctgcaccaccatgctgttatatgggcagaaagaatgtcctcactatgcaagggtcctccatcattaatgcctctctaataaaaacttctcaaagctgctttacttccaaaggaagctggagtcattcactgcaagggccatcaaaaggcatcagatcccatcactcagggcaacacttatgctgataaggtagttaaagaagcagctagcgtttcaacttctgtccctcatggcccgtttttctccttctcattggtcactcctatttactcttctactgaagtttccacctatcaatctcttcccacacaaggcaaatggttcttggatcaaggaaaatatctccttccagcctcacaggcccattctattctgtcatcatttcataacttcttccatgtaggttacaagctgttagcccacctcttaaaacttctcatttcctttccatcgtgaatatctatccccaatcctccactcttgactccctcttggagtggatagatgatctttgctgacaggacacactccaacactttcaccctgatgaagtcctattctttacttttatactcactcttgttctcattcccattcttatgccaccctctacctctccccagctatctccaccacactatcaatctcactcactctctcctagccatctctaatccttctttaagaaacaattgctggctttcaaaagaacaaagctggaggcatcatgctacctgacttcaaactatactacaaggctacagtaaccaaaacagcatggtactggtaccaaaaaagagatatagaccaatagaacagaacagagccctcagaaataatatcacacatctacaaccatctgatctttgacaaacctaacaataacaagaaatggggaaaggattccctatttaataaatagttctgggaaaactggctagccatatgtagaaagctgaaactggatcccttccttacaccttctacaaaaattaattcaagatggattaaagacttaactgttagacctaaaaccataaaaaccctagaagaaaacctaggcaataccattcaggacataggcatgggcaaggacttcatgtctaaaacaccaaaagcaatggcaacagaagccaaaattgacaaaagggatctaattaaactaaagagcttctgcacagcaaaagaaactaccatcagagtgaacaggcaacctacagaatgggagaaaatttttgaaatctacttatctgacaaaaggctaatatccggaatctacaaagaactcaaacaaatttacaagaaaaaaacaaacaaccccatcaaaaagtgggcaaaggatatgaacagacacttctcaaaagaagacatttaagaagccaacagacacatgaaaaaatgctcatcatcactggccatcagagaaatgcaaatcaaaaccacaataagataccatctcacaccagttagaatggccatcattaaaaagtcaggaaacaacaggcgctggagaggatgtggagaaataggaacacttttacactgttggtgggactgtaaactggttcaaccattgtggaagacagtgtggcaattcctcagggatctagaactagaaataccatttgacccagccatcccattactgggtatatacccaaaggattataaatcatgctgctataaagacacatgcacacgtatgtttatcgtggcactattcacgatagcaaagacttagaaccaacccaaatgtctatcaatgatagactggattaagaaaatgtggcacatatacaccatggaatactatgcagccacaaaaaaggatgagttcatgtcctttgtagcaacatggatgacgctggaaaccagcattctcagcaaactatctgagcaaacaaacaaggacaaaaaaccaaacaccgcatgttctcactcataggtgggaattgaacaatgagaacacttggacacagaaaggggaacatcacacaccggggcctcttgtgcggtgcggggacgggggagggatagcattaggagatacacctaatgtaaatgatgagttaatgggtgcagcataccaacatggcacatgtatacatatgtaacaaacctgcacattgtgcacatgtaccctataacttaaagtataatttaaaaaaataagtaaataaataaataaaaaagaaacaattgctggctttgcaattctctttcctccaaaatcgccgaggcctcaatttactcattgctgaaaaaggaggactctgtatatttttaaatgcagagtgttgtttttacctaaatcaatctggcctggtatatgacaacataaaaaaactcaaggatagagcccaaaaacttgccaaccaagcaaataactatgctgaacccccttgggcactctcttaattggatgtcctgggtcctcccaattcttagtcctttaatacctgtttttctctttctcttattcagaccttgcgtcttctgtttagtttctcaattcatacaaaaccatatccaggccatcaccaataattctatatgacaaatgctccttctaacaaccccacaatatcagcccttaccccaaaatcttcagctgaa

SEQ ID NO: 265 - DNA, 804 bp, Homo sapiens
gagagacaggactagctggattttctaggctgactaagaatccctaagcctagctgggaaggtgaccacatccacctttaaacatggggcttgcaacttagctcacacccgaccaatcaggtggtaaagagagctcactaaaaagctgattaggcaaaaacaggaagtaaagaaatagccagtcatctattgactaacagtttagctggagggacaatgatcgggatataaacccaggcaatcgagccggcatcgggtacactcttttggtcgcctccgtttgtatgggagctctgttttcactctactaaatcttgcaactgcacgctcttctggtctgtgtttgtcacggctggagctgagctttcgctcgccatctgccactgctgtttgccaccctcacagacccgccaccgacttccatccctccagatccggcagggtgtccgctgtgcttctgatccagcaaggcgcccattgctgctcccgatcgggctagaggcttgccattgttcctgcatggctaagtgcccgggttcatcctaattgagctgaacactcgtcactaggttccacggttctcttccgtgacccacggcttctaatagagctataacactcactgcatggcccaagattccattcctttgaatccctgcggccaagaatcccaggtcagagaacacaaggcttgccaccattttggaagcagcccgctgccatcttggaagcagcccaccaccatcttggaagcagcccaccaccgtctggggagctctgggagcaaggaccctccggtaacat

SEQ ID NO: 266 - DNA, 800 bp, Homo sapiens
agacaggactagctgggcttcctaggccgactaagaattcctaagcctagctggggaaggtgaccgcacccacctttaaacatggggcttgtaactcagctcacacccgaccaatcaggtagtaaagagggctcactaaaatacaaattaggctaaaagcaggaggtaaagaaatagtcaaatcatgtatcatctgaacgcacagggggagggacaataattgggatataaaccccaggcattcgagctgggagtggcaaccccctttgggggaagccgcctttgggtcccctcccattgtatgggaactctgttttcactctattaaatcttgtaactgcacactcttctggtccatgtttgttacagctcgagctgagcttttgctcaccgtccaccactgctgttggccgccatcgcacacctgccactgacttccacccctctggatccggctgggtgtctgctgcactcctgatccagcgaggcgcccactgccactcccagttgggctaaaggctcgccattgttcctgcacagctaagtgcccgggttcatcctaatcaagctgaacactagttgctgggttctacggttctcttctgtgacccatggcttctaatcaagctgtaacactcaccacataggcccaaggtttcattccttggaatctgtgaggccaggaaccccaggtcagagaacaaaaggcttgctgccatcttgggagcggctgccaccatgttgggagcggcccaccaccatcttgggagctctaagaacacagacccacccgtaacatt

SEQ ID NO: 267 - DNA, 5222 bp, Homo sapiens
gtcaggcccccgagcccatgctaagccatcatatcccctgcgacctgcaggtatacatccaggtggcctgaagtaattgaagaatcacaaaagaagtgaaaatggcctgttcctgccttaactgatgacattaccttgtgaaattccttctcctggctcatcctggctcaaaagctcccccactgagcaccttgtgtcccctgcccctgccagccagagaacaaccccctttgactataattttccactacctacccaaatcctataaaacggccccacccctatatcccttcactgactctcttttcggactcagcccacctgcacccaggtgattaaaaagctttattgctcacacaaagcctgttggtggtctcttcacacagacatgtgtgaaatttggtgccgtgactcagatcgggggacctcccttgagagatcaatcccctgtcctcctgctctttgctctgtgagaaagatccacctacaacctctggtcctcagaccaatcagcccaagaaacatctcaccaattttaaattgggtaagcggccgctttttactgtcttctccaagctctcactatccctcaacctctttctcctttcaaccttggcgccacacttcaatctctcccttctcttaatttcagttcctttccttttctggtagagacaaaggagacacattttatccgtggactcaaaactctggtgctggtcacggactcatgaagacagtcttcccttggtgtttaattattgcggggacgcctgctttggctgctcacccatattgcagcgcagggctgctcacccaaccccttctctctgtgtctctaccccttttccactttcccggggggcaagcacctcccaccccttctccactttcctggggggcaagcacccctcaccccttctctccatatctctaccctctcttttctctggactggcctccttctctacaggcaaccttccaccttcttctcccttagcctgtgttctcaagaactgaaaacctcttcaactcacacttgacctaaaacctaaatgccttattttcttctgcaatgctgcttaaccccaatacaaactcgacaatggttccaaatagccagaaaacagcactttcgatttttccatcctacaagatctagataattcttgtcataaaatgggcaaatggtctgaggtgcctgatgtccaggcattcttttacacatcagtccctccctagtctctgttcccaatgcaactcatcccaaatcttccttctttccctcccacctgtcccctcagtcccaaccccaagtgttgctgagtctttccaatcttcctttttcacagacccatctgacctctcccctcctccccaggctgctcctcaccaggccaagccaggtcccaattcttcctcagcctccgctcccccaccctataatccttttatcacctcccctcctcacacccagtctggcttacagttttttctgtgactaccctcccccacctgcccagcaatttcctcttaaaaacgtggctggagctaaaggcatagtcaaggttaatgctcctttttctttatccgacctctctcaaatcagttagtgtttaggctctttttcatcaaatataaaaactcaacccagctcatggctcatttggcagcaaccctgagatgctttacagccctagaccctaaaagatcaaaaggccctcttattctcaatatacgttttattacccaatccactcctgacattaaataaaactccaaaaattaaattctggccctcaaaccctgcaacaggacttaattaacctcgccttcaaggtgtacagtaatagagaagagttgcaattacttgcctccactgtgagagaaaccccagccacatctccagcacacaagaatttcaaaacgcctacgccacagtgatcaggtgttccttcaggacttcctcccccaggatcttgcttcaagtgctggaaatctggccactgggccaaggcatgcctgcagcctgggattccttctaagccttgtcccatctgtgcgggaccccactggaaatcggactgttcaagtcacctggcagcctctcccagagcccctggaactctcgcccaaggctctctgactgactccttcccagatcttcttggcttagaggccgaagactgacactgcccaatcacctcggaggcttcctagaccatcacagatgctttgggtaactcttacagtggagggtaagttcaacctcttcttaatacagaggctacccactccacattaccttcttttcaagggcctgtttcccttgcctccataactgttgtgggtattgacggccaggcttctaaacctcttaaaactccccaactctggtgccaacttggacaacattcttttatgcactcctttttagttatccccacctgcccagttcccttattaagccaagacattttaactaaattatctgcttacctgactattcctaggctgcagccacacctcattgccacccttttccccagttcaaagccttcttcacatcctccccttgtatctctccaccttaatccacaagtataggacacctctactccctccttggcaatggatgatgcaccccttaccatcccattaaaacctaatcacccttaccccactcaacgccaatatcccatcccacagcacactttaaaaggattaaagcctgttataccttgcctgttacagcatggccttttaaagcatataaactctccttacaattcccctattttacctgtccaaaaaccagacaagccttacaggttagttcaggacctgcaccttatcaatcaaattgtcttgcctatctaccccatggtgccaaacccatatactctcctatcctcaatacctccctccgcaacccattattctgttctaggaaacctagctgaccccatagatcctaaatcctttccccactcctctttctgttccttgaagacagctttagagactgctcccacactagctctccctgactcatcccaacccttttttcattacacacaaccaaagtgcagggttgtgtggttgaaattcttacacaagagctgagaccacgcccagcagcctttttatccaaacaagttgaccttactgttttagcctagccctcatgtctgtgtgtggcagctgctgctgccttaatacttttagaagccctcagaatcacaaactatgctcatctcactctctacagttctcataacttccaaaatctattttcttcatcacacctgatgcatatactttctgcccccctccactacctctcagcaagccgaactcattgccttaactcgagccgtcagtcctgcaaaaggactacatgtcaatatttatactgactctaaatatgccttccatatcctgcaccaccatgctgttacatgggcaaaaacaggtttcctcactatgcaattgtcctccatcattaattcctctttaataaaaactcttctcaaagccgctttacttccaaaggaagctggagtcattcactgcaagggccatcaaaagtgtcagatcccattgctcagggcaacacttatgctgataaggtagctgaaaaagcagctagggttccaacttccgtccctcactacgagtttttctccttctccttggtcactcccacctactcccccactgaaactgccgcctatcaatctcttcccacacaaggcaaatggttcttagaccaaggaaaatatctccttccagcctcacaggcccattctattctgtcatcatttcatatcctcttccatgtaggttacaagccactagcccgcctcttagaatctctcatttcctttccattgtggaaatctatccttagggaaatcacttctcagtgttccatctgctattctactactcctcagggattgttcaggtcccctcaccttccctacacatcaagcttggggatttgcccctgcccaggacaggtaaattgactttactcacatgcctcgagtcaggacactaaaatacctcttggtctgggtagacactttcactggatgggtagaggcctttcctacagggtctgagaaggccatcacagtcatttcttcccttttgtcagacataattcctcggtttggccttcctacctttatacagtctgataacggaccggcctttattagtcaaatcacccaagcagtttctcaggctcttggtattcagtggaacctttgtacccctcaccatcctcaatcttcaggaaaggtaaaatggactaatggtcttttaaagacatacctcaccaagctcagcctccaacttaaaaaaaaaaaaggagtctgtcaagaatagagcccaaaaactcaccaaccaaacaagtaattatgctgaacccccttggatactctctaattggatgtcctgggtcctcccaattcttagtcctttaataccagtttttctccttctcttattcagaccttgtgtcttccgtttagtttctcaattcatacaaaaccgcgtccaggccatcaccaatcattctatatgacaaatgctccttttaacaaccccacaatatcgccccttaccacaaaatcttccttcagcttaatctctcccactctaggttcccataccacccctaatcctgctcaaagcagccctgagaaacatcgcccattatctcttcataccaccccaccaaaattttcactgcctcaacacttcaacactattttatgttatttttcttattaatataagaagacaggaatgtcaggcctctgagcccaagctaagccatcatatcccttgtgacctacaggtatacatccagatggcctgaagtaactgatgaatcacaaaagaagtgaaaatggcctgttcctgccttaactgataatattaccttgtgaaattccttctcctggctcatcctggctcaaaagctcccccactgagcactttgtgtcccccgcccctgccagccagagaacaaccccctttgactgtaattttccgctacctacccaaatcctataaaatggccccacccctatctcccttcactgactctcttttcgaactcagcccacctgcacccaggtgattaaaaagctttattgctcacacaaagcctgtttggtggtctcttcacatggatgcgagtgaaa

SEQ ID NO: 268 - DNA, 6733 bp, Homo sapiens
cttcctccttagcctgtattcttaaaaacctaaaacccctttgactaacacctgacctaaaacctaaatgtcttattttcttctgtaatactgcttggccccaatacaaattcgacaatagttccaagtggccagagaatggcacttttgatgtatctatcctacaagacctagataatttttgttgaaaattgggcaaatggtctgaggtgccttacgtcaaggcattttttacactttgctctttccctagtctctgctccagatgcgactcattccagattttcctcctttctctcccatctgctctttaggtctccacccaagctcagagtcctctgaatcctccttttccactgacccctctgacctctctcctccttccccagccgctcctcaccaggctgaatcgggccccaattcttccacagcctctgctccccaaccctataacccttctattaactcccttcctcacacccaggctggcttacagtttcgttctgcgactagttttcccccacctgcccaacaatttcctcttagagaggtggctggagctgaaggcatagtcagggtacatgtgcctttttctctgtcagaccttttccaaatcagccagcatttaggctctttctcatcagacaccactaaatacatacaggaattccaatatctaactcagtcctacaatttaacctggagtgacttaaatgacaccctgacctctaccctcttcccaggtgaatgagaaagagtttattttctagcccagtcctatgcagacacctgccggcttcatgagccaggcctccaagagggcaccagagcagttccccgaggggatccccattggcaataccagatggattccccaggtatagctaggtgagattacatggtctcctacctagtcaaggggctcaaaaaggcagcatacaaagcttttaattatgacaagttaaaggaaactacccaaggtaaagatgaaaacccagcccagttcatggcctgcttagcagctacccttagacgctttacagccctagacccagagggtccagaagaattccttatccttaatatgcattttatcacccaatccactcctgacattagaaaaaaactccaaaagttggattctggccctcaaaccccacaacaggatttaataaaccttgccttcaaggtgttcaataacagagaagaagccgccaagcagcaatgtatctctgagttacagccacttgcctccgctgtaagacaacccacaaccacgtctccagcatacaaaaccttcagaacatccaagccacagctcccaggggctcctttaaaacctcctcgtggaccttgcttcaaatgccaaaagtctggccactgggcctcagaatgcccacagcctgggattcctcctaagccatgcgctatctgcacaggcccccactggaagtcggatgtccaactcacatcactgcagctcctaaagctcctggagctcaaatccaatgttccttggctgactccttcccagatctcctcagcttagcggctgaagactgacactgcctgatcgcctcagaagccgctggaccatcaccgatgttgagctttgggtaactcttacagtggagggtaagtccatcccctgtttaatcaatacaggggatacccactccacattaccttcttttcaagggcccatttcccttgcccccataacaactgttgtgggtattgatggccaggcttctagaccccttaaaactccccaactctggtgccaacttggacaacattattttatgcactgctttttagttatcaccacctgcccagttcccttgttaggctgagccattttaactaaattatctgcttccctgactattcctggactacagccacacctcattgctgcccttttgcccaatccaatgcctcttttgaatcttcctctcgtgtctccctaccttaatccacaagtataggacacctctactccctccttggtgaccgatcaggcaccccttatcccattaaaacctaatcacccttaccctgctcaacaccagcaccccatcccacaacaggctttaagaggagtaaagcctgttatcactcacctgttacagcatggccttttaaagcctacaaattctccttacaactcccttatcctacctgtccagaaactggacaaatcttacaggctggttcaggatcttcaccttattaaccaaattgtcttacctatccatcctgtggtgctaaacccgtatactctcctatcttcaatacctccctccataactcattattccatcctcgatctcaaagaagctctctccactattcctttgcacccctcatcccaacctcctctcgctttcacatggactgaccctgacacccacaaatctcagcaactcacctggactgtactgccacaaggcttcagagacagcccccattactttagtcaagctctttctcatgatctactttctttccgtccatctgtttctcaccttattcaatatatgggcgaccttctcctctgcagcccctcttatgaatcttcctaacaggataccctcctgctccttcaacatctattctgaaaggggtattgcgtatccccttctaaagcccaaatttcttccccatccattacgtatctcggcatagtccttcatcaaaacacatgtgctctccctgctaatcatgtccagctaatctccaaaaccctaaccccttctacaaagccacaactcatttccttcctaggcatggttggatactttcgcctttggataccaggttttgccatcctaactaaaccactatataaactcacaaaggaaaacctgactgaccccatagaccctaagtcctttccccactcttcttttcattccttaaagatgtcctagaaacagctcccacattaacactccctaactcgtcccaatccttcttcttacatacggctgaaatacatggctgtgcggtcggagttcttacacaggaaccaggcccacgacctgtagccttcctatccaaacaacttaacttcacagttctagactggccctcatgtctacgtgaggcggcagccaccacttcaatacttctagaggtcctcaaggtcacaaaccatgtcccacttactctttacatctctcataactttcaaaatctattttcctcctcacacttggcgcatatactttctgccccccgactcctccaattttactcactattcattgaaactccctacatcaccatgctgttatatgggcagaaagaggttttgtcactacacaagtgtcctccatcatcaacgcttccttaataaaaatcctccttaaggctgctctactgcctaaggaagccagagtcattcactgcaaggggcctcagaggtcaccaaatcccattactcaaggcaatgcttatgctgataatgcagcaaaagaagcagctagtattcccacatctgtccctcacggccagtttttttccttcactcccacatattctcccactgaaactattatctattaatcccttcctactcaaggcaaatggttcttggatcaaggaaaatacctccttcctgcctcacaggctcattctatcttatcttcctttcataacctctttcatgtgggttacaagccaatggcccatctcttagaacctctcatttcttttccatcatggaaatccatcctcaaggaaattacttctcagcattccatctgctactctaccacccctcagggatatctcaggcctccttcctttcctgtacatcaagcttgaggatttgcccccacccaagactggcaggttgactttatccatatgcaccgagtcaaaacactaagataccgtttggtctgggtagatacattcactggatgggtagaggcctttcccacagggtctgagaaggccactgcagtcatttcttccctcctgtcatattggccttcccacctctatatagtgcaataacggaccagccttcattaggtcactcaagcagtctcccaggcccttggcatccagtggaaccctcatgccccttaccgtcctcaatcttcaggaaaggtagaaagaactaatggtcttttaaaaacacacctcaccaagctcagcctacaacttaaaaaagactgcacagtacttttaccgtttgccctccttagaattagaacctgtccttgagaagctatagggtatagtccatttgaacttttatatggatgtaccttcttgttgggccccaaccttgtgccagacaccagccctctaggcgactatcttccagtcctccagcaggctagacaggaaatttgccaggctgctaatcttctcttgcctactccagattcccagcgatacaaagatacccctgctggattatcagttcttgttaagaatctgacccctcaaactctacaaccttgatggactggaccctacttagtcatctatagtaccccaactgccatgcacctgcaggaccctccccattgggttcaccattccagaataaagctgtgtccatcggacagccagcctgatctctcctcttcctcctggaagtcacaagtactctcccctacttcccttaaactcacctgcatttctgaataacagtaataacccttatgagcctaatacatcccttcattctattaggtctattcatccttaccctactttttgcaatggggctttacgcagtcacctgcactacttggactgcaccccaaaaacttgtcatccctactatcttctgtctagtcatacacctattcaccattctcaactactcataaatgccttgcccttgtttacactgccggtttacacttttcctccagaccatcataactgatatctcccggttttacctcaaaccgccacccttaactctctcttggagtggatagaagatcttcaatggcaagatacactccaattcttctatcctgatgaagtgcttttttttttacttttctactcactcttatccttacctccattctccagtcactctctacctctctctagttacctccagcatactatcagtctcacccactctctcctcactgcctccaatccctctctagcaaagaattgttggctatgcatttccctttcttcctgctcttacacagccatccccgctctgtaggctgactgggctacctctcctgtctgcctgcacctccgaacctcctttaatagccctcatctttacccacctgaggaaattctttactttctagacagatttggtgagaactccccagacatttcgcaccaacaagctgccacatttctccgcatctagttacagcacctttttccttatgtcaattccaccctcaccccccatatttggacccctcagcacacaaacaaccatccctgtggctgctcctttatgcatctcccgacaacaccctactggaatcactttaggcaaccttccaccatccaaatgttcctttactcttcatcttcagaacccagccacacacattaccaaacagatgggaggattccaacttcgcattaccgataagccctctatcattactgacaaactaaaaaacattggcagtcactattgtttaggaagacacctaccctgcatctcactccatccttcgctaccctccatctgctcatctgactctcctcctggcccctcctcttgtttgcttatacccagccccatgaatagtagtgaaaggttactcatagacactatgttctttctcatacaccataagaaccgaacctctccctctatgcagttgcaccatcaatccccattacaacctctaatggctgcttcccttgctggatctctaggattttgggtgcaggactcctctttcagtacaccctctcaccttttcactttatatttccggttctgcctgacactaggtctcttctttttatgtggctcttccacctacatgtgcctacctgccaactggatggacacacgtactctagtcttccttacccccaaaatccagtttgcagatgggaatgaaaaactgcctgtccccctcatgacatcaacacaacaaaaaaaagtcatcccactaatccctttacttgtgggtctaggactttctgcctccactattgcacttggaactggaatagcaggcatttcaatctctgtcacaacattttgcagcctctctaatgacttctctgctagcattacagatatgtcacagacgttatctgtcctccaagcccaggttgactctttagcttcagttatcctccagaactgccggggcctcgatttacttgctgctgaaaaaggaggactctgtatatttcttaatgaagagtgttgtttttacttaaatcaatctggcctggtatatgataacatcaaaaaactcaaagacagctcaaaaactcgctaatcaggcaactaatcatgctggatccacctggccactctctaactgggtatcctggcgtcttccaatcgttagtcctctaatatctatcttcctcctccttttatttaggccttgtgtcttcccaattaaactctcaattcctatgaaactgcatccaggctatcactaatcactctatatgacaaatgctgctttgaacagccccacagtatcaccccttaccccaaaatcttacttcaatctaa

SEQ ID NO: 269 - DNA, 160 bp, Homo sapiens
tgaaatgtgtccaaaatgtaaaaaaggaaaacattgagctagtcagtgtcactctaagtttgataaagatgggaacccaatttcaggaaatgccatgaggtgccagcccatcccggcccccactccagactggggcatttccagctcaggccattccttc

SEQ ID NO: 270 - DNA, 5398 bp, Homo sapiens
ccctttgggtcccctcccattgtatgcgagctctgttttcacttattaaatcttgcagctgcacacttttctggtccgtgtttgttcctgctcgagctgagctttcactcactgtccaccactgctgtttgccgccgtcgcatacccgccattgacttccacccctccggatctggcagggtgtctgctgcatttctgatccagcgaggcacccattgccgcttccgtttgggctagaggcttgccattgttcctgcacggctaagtgcaggaatttgtcctaatcaagctgaacactagtcactgggttccacggttctcttctgtgacccacggcttctaatagagctataacattaaccgcatggaccaaggttccattccttggattccgtgaggccaagaaccccagatcagagaacaaaaggcttgcttccatcttgggagtggccgccaccatcttgtgagctctaagaacaaagacccacctgtaacatttggtggcaaccgtatggtgattctccaaagcggtgagtaatattggaccactttggcttgctattctgtcctatccttccttagagttggaggaaaatactgggcacctgttggccagttaaaaacgattagtgtggctgccggacttaagactcaggtgtgaggcttcctggggaaaggctttctaacaacccccaacccttctgggttgagagcattggtctgcctggaagcagcttccactttcacagtttcctgggggaagccaagggctgactagaggcagaaagctgttgtcccgaactcctggcattggctggttgagatcatggcgcagccagaagtctctactcatcagttgcccatgtgtgcacccctacctctccttctgacccatacctcctgggtcctgaccacaactttcttgaaagtgtagcccccaagttctccttacctctgattctactttctctgatccctgactcctagatactaatgcttcagactttcacttcctctcctaagtattagagcaagtggtatcttcaaagggatccaaggaagctctatgtggtgtccttaggcaactaggctatgaacccagggagtcttgtccctggtgcccctcccaatttaggtatatagctcttgacatggacagttatgtgggacccattcctcaccacccttgccagggccccaagttctattctgagctgtggccccaagtttgtaaatggctatgaggattgctctcccattgtgtaagatgctctcctcccccaattgctaccctgcttacccctctgcaatacaatctccaagccttggcttcttggccaggaccttagaactgataacccagtactttaacaaacggaactaggtctatgacaacatgatagatcaggatgaaagtgaattgagtaaattaaagggagatgcatattcctatagtggcaaatgggggcaatgagcgaacatccttctgctgtgttcccaaaatccatctacaaaaagagagagaggaaagagagaaagaaaagagggaaaaagggaaaagagagaggggaaagagagagagaaaaagagagagaggaaagaaagaggaaaagagggagtcaaagaaagaggagagagaggggagagagaggggaaagagagagagaggaaagagagagaggggaaagagaaaggcagagacagaaagagagagataaaagtagtaaagaaaaaaacagtgcaccctattcctttaaaagccagggtaaatttaaaacctacaattgataattgaacatcttctctgtgaccctgtaacactccaataccaccttgttgtcagtataaacaagggcatagcccaaaagcactgaggacactgacaatcagtagccttcctatcaaaaatccttaacccagtaacccacggatggcccaaatgcatttaatctgtagaggcaactgctttgctagcagaagaaagtagaaaaataacttttagaggaaacctcattgtgagcacacctcagaactatcctaagtaaaaaaagcagaaaggtagcttactaactcaaaaatcttaaagtatggggctattccgttagaaaaagatgacttaacattaaccactgaaaatttccttaacctggcagatttcctaacaggggatttaaatcttaactaccatacaaaagtccgaccagacctaggagaaactcccttcaggacaggatgatagatggttcctcctgggtgattgaaaaaaaaaacaaaaaaccacaatgggtattcagtaactgatagggaaactcttatagaagcagttaggaaaattgcctaataattggtctgttcaaaggtacaagctgtttgcactcagccaagccttaaaatacttacagaatcaagaaactctatctcaatcctgactcaaaaggttacctacaccccctctgaaacaaatttgcataagaattgttgtttatgggaatgcatcttgatggggcagctgggttgttatgaaatactcaggaacccagcccagctctagaactcacccctgagcacaaaggcaatgttaggcatggtggtaaaggaccactagaatccagcagcccagacccctttctttgtggtcaagaaaggcgggaaaacaggtgtaggactgctacatcggtgagcgtaactaatccgataagcagaggtccatgggtggttatgcaccctggaaaggaataagcattaggaccatcaaggatgctctatgactaatgctcattggaaaatgactagggctgctggcatccatatgttcttttttcagatgggaaacgttccccgcaaggaaaaactccactaagatgtattctggagaatttggcccagtcagagtgtatgtaccttttaccctgtcagacttgaagcaaactaaaatagacctaggtaaattctcagataactctgatgactatattggtgttttacaagggttaggacaatcctttgatctgacatggagagatacaatgttactgctagatcagacactaaccccaaatgagagaagtgccaccataactgtagcccaagagtttggcgatctctggtatctcagtcaggtcaataataggatgacaacagaagaaggagagcaattcctcacaagccagcaggcagttcctagtgtagactctcactgcgacacagaatcagaacatggatattggtgccacagacatttgctaacttgcgtgctagaaggactaaggaaaactaggaagaagcctataaattattcaatgatgtccactgtaacacagggaaaggaagaaaatcctactgcttttctggagagactaagggaggcattgaggaagcgtatctctctgtcacctgactctactgaaggtcaactaatcttaaaggataagtttatcactcagtcagttgcagacattagaaaaaacttcaaaagtccaccttaggcccgcagcaaaacttagaaaccctattgaacttggcaaccttggttttatataatagagatcaggaggagcaggcagaacgggacaaatgggataaaagaaaaaaggccaccgctttagtcatggccctcaggcaagtggactttggaggctctggaaaagggaaaggctgggcaaatcaaacgcttaatagggcttgcttccagtgcggtctacaaggacactttaaaaaagattgtctgaatagaaataagccgccccctcgtccatgccccttatgttaagggaatcactggaaggcccactgccccaggggacgaaggtcctctgagtcagaagccactaactagatgatccagcagcaggactgagggtgcccggggcaagcgccagcccatgccatcaccctcacagagccccgggtatgcttgaccattgagggccaagacgctaactgtctcctggacactggcgcagccttctcagtcttactctcttgttccagacaactgtcctccagatctgtcactatccgaggggtcctaggacaggcagtcattagatacttctcccagccactacttgtgactggggaactttactcttttcttatgcctttctaattatgcctgaaagccccactcctttgttagggagagacatcctagcaaaaccaggggccattatacactagaattaggagaaggaaaaagggtaaatatatatacagactctaagtatgcttacctagtcctccatgcccacgcagcaatatggagagaaagggaattcctaacttctgagggaactcctatcaaacatcaggaagccattaagagattgttattggctgtacagaaacctgaagagatggggtcatcagaaaggaaaacaaagggaaatagaagggaaccggcaagtggatattgaagccaaaagagccacaaggcgggaccctctgttagaaaagcttatagaaagacccctagtatggggtaatcccctccaggaaaccaagccccagtactcagccgaagaaatagaatggggaccctcacaaggacatagtttcctcccctcaggatggctagccaccaaagaaggaaaaatacttttgcctgcagctaaccagtggaaattacttaaaatccttcaccaaaccttttactcagacattgatagcacccatcagatggtcaaatcatttactgggccaagcctttgcaaaactatcaagggcctgtgaagtgtgccaaagaaataatcccctacacttcaggccatacatttcaatccctgtatctttaacctccttgttaagtttgtctcttccagaatcaaactgtaaaactacaaatcgttcttcaaatggagccccagatgcagcccatgactaagatctaccgtggactgctggactggcctgctagcccatgctccaatgttcatgacatcgaaggcacctctccagaggaaatctcaactgcatgacccctattacaccccaattcagcaggaagcagttagagcggtcgtcaggcaacctccccaacagtacttgggttttcctgttgagaaggggaactgagagacaggactagctggatttcctaggtcgactaagaattcctaagcctagctggggaaggtgacagcacctacctttaaacatggggcttgtaactcagctcacacctgaccaatcaggtagtaaagagggctcactaaaataccagttagactaaaagcaggaggtaaagaaatagtcaaatcatgtatcgcctgagagcacagggggagggacaatgatcgggatataaacccaagcatttgaactggcggtggaaaccccctttgggtctcctcccattgtatgggagctctgttttcactctatgaaatcttgcagctgc

SEQ ID NO: 271 - DNA, 930 bp, Homo sapiens
ggggaaaagaaagagagatcagattgttaatgtgtctgtatagaaagtagacataagagactccattttaatctgtaaccctacccccaaccctgtgttccctgagacatgtgctgtgtcaactcagggttaaatggattaagggctgtgcaagatgtgctttgttaaacagatgcttgaaggcagcatgctcattaagagtcatcaccactctctaatctcaagtacccagggacacaaacactgcggaaggctgcagggacctctgcctaggaaagccaggtattgtccaaggtttctccccatgtgacagtctgaaatatggcctcttgggaagggaaagacctgacagtcccccagcccgacacccataaagggtctgtgctgaggaggattagtaaaagaggaaagaacgcctctttgcggttgagacaagaggaaggcatctgtctcctgcctgtccctgggcaatggaatgtctcggtgtaaaacccgattgtatattccatctactgagataggggaaaaccgccttagggctggaggtggcacattcgggcagcaatactgctctttaaggcattgagatgtttatgtgtatacatatctaaagcacagcacttaattctttaccttgtttatgatgcagagacctttgttcacgtgtttacctgctgaccttctctccactattatcctatgatcctgccacatccgcctctccgagaaacacccaataatgatcaataaatactaagggaactcagaggccaataaatacaaagggatcctccgtatgctgaacgccggtcccctgggcccccttttttctttctatatactttgtgtctgtgtctctttcttttccaagtctctcgttccacctaacgagaaacacccacaggtgtggaggggcaacccaccccttca

SEQ ID NO: 272 - DNA, 454 bp, Homo sapiens
gtcaggcctctgagcccaagccaagccatcgcatcccctgtgacttgcacgtatacgaccagatggcctgaagtaactgaaaaatcacaacagaaatgaatatgccctgccccaccttaactgatgacattccaccacaaaagaagtgtaaatggccagtccttgccttaagtgatgagattaccttgtgaaattccttctcccggctcatcctggctcaaaaagcacccccactgagcaccttgcgacccccactcctgcccgccagagaacaaaccccctttgactgtaattttcctttacctacccaaatcctataaaacggccccacccttatctcccttcgctgactctcttttcggactcagcctgcccgcctgcacccaggtgattaaaagctttattgctcacacagagcctgtttggtggtctcttcacagggacgcgcatgaaa

SEQ ID NO: 273 - DNA, 686 bp, Homo sapiens
gtcagacctctgagcccaagctaagccatcatatcccctgtgacctgcacgtatacatccagatggcctgttcttgccttaactgatgacattccaccacaaaagaagtgaaaatggcctgttcctgccttaactgatgacattaaccttgtgaaattccttcgactggctcatcttggctcaaaaactcccccactgagcaccttgtgaccccccacccctgccagacagagaacaaccccctttgactgtaattttcctttacctaccgaaatcctataaaagggccccacccctatctcccttcactgactccttttttggactcagcctgcctgcactcaggtgaaataaacagtcttgttgctcacacaaagcctgtttggtggtctcttcacatggacttcagtgaaatttggtgccgtgactcggatcgggggacctcccttgggagatcaatctcctgtcctcctgctctttgctccatgagaaagatccacctacgatctctggtcctcagatcaaccagaccaaggaacatctcaccaattttaaatcgggtaagcggcctctttttactctcttctccaacctctctccctatccctccacctctttctcctttcaatcttggtgccacacttcaatctctcccttctcttaatttcagttcctttccttttctg

SEQ ID NO: 274 - DNA, 5673 bp, Homo sapiens
gtcaggcctctgagcccaagctaagccatcatatcccctgtggcctgcacgtatatatccagatggcctgaagtaactgaagaatcacaaaagaagtgaaaatggcctgttcctgacttaactgatgacattaccttgtgaaattccttctcctggctcgtcctggctcaaaagctcccccactgagcaccttgtgtcccccacccctgcccaccagagaacaaccccctttgactgtaattttccattacctacccaaatcctataaaacggccccacccctatctcccttcgatgactgtctttttggactcagacctcctgcacccaggtgaaataaacagcctcgttgctcacacaaagcctgtttggtggtctcttcacatggacaccagtgaaatttggttccgtgactcggatcaggggacctctcttgggagatcaatcccctgtcctcctgctctttgctctgtgagaaagatccacctatgacctctggtcctcagactaaccagcccaaggaacatctcaccaattttaaatctggtaagtggcctctcttcactctcttctccaacctctctcactatccctcaacctctttcttctttcaatcttggcaccacacttcaatctctcccttctcttaatttcagttcctttccttttctcgtagagacagagatgatgcattttatctgtggacctgaagctccagcaccagtcacggacttgggtttaatcatgtggggatgcctgcctgattatttacccacatttcattggtgtctgatcaccacggggatgcttgccttggtcattcacccacattccttggtggcaagtgaattgcgggggcgcctgctttggctgctcacccacattgcagcccagggctgctcacccaaccccttctctccatgtacccaccccttctccactttcctggggggcaagcacctcccaccccttttacacttttctggggggcaagcaccccccactccttctctctgtgtctctactctctcttttctctgggcttgcctccttcattatggacaaccttccaccttccattcctccttcttctcccttagcctgcattctcaaaaacttaaaacctcttcaactctcagctgacctaaaatctaagcatcttattttcttctgcaacactgcttgaccccaatacaaactcgacagtggttccaaatagccagaaaatggcacttttgatttttccatcctacaaaatctagataattcttgtcgtaaaatgggcaaacggtctgaggtccctgatatccaggcattcttttacacattggtccctccctagtctctgttcccaatgcaactcatcccaaatcttgcttctttccctcctgcctgttctctcagtcccaaccctaatcatcactgggtctttccaatcttccttttctacagactcatctgacctgtcccctcctcaccaggctgctccttgccaggccgagctaggtcccaattcttcctcagcctctattccctgaccctataattcttttttcacctcccctcctcacacccggtctggtttacagtttcgttccacaactagccctcccccacctgcccagcaatttcctcttaaaaaggtggctggagctaaaggcgtagtcaaggttaatgttcctttttctttatctgacctctcccaaatcagttagcatttaggctctttttcatcaaatataaaaacccagcccggtccatggcccttttggcagcaaccctgagactgtttacagccctagaccctgaagggtcagaaggccatctcattctaaatatgcattttattacccagtcagctcctgacattagaataaagctccaaaaattaaattccagccctcaaaccccacaacaggacttaattaaccttgccttcaaggtgtacaataatagagtagaggcagccaagtagcaatgtatttctgaattgcaattccttgcctccactgtgagacaaaccccagacacatctccagcacacaagaactccaaatgcctgaaccgcagctgccaggggttcctccagaacctcctcccccaggagcttgctacaagtgccagcaatctggcctctgggccaaggaatgcctgcagcctgggcttcctcctagccatgtcccatctgtgcaggaccccactggaaattggactgtccaacttgccccgcagccagtcctagggcccctaaagctctagcccaaggctctctgactgactcctccccagatctgctcagcttagcagctgaagactgatgctgaccaatcacctcggaagccccctggaccatgatggacactgagctttgggtaactcttatggtggagggtaagtccgtccccttcttaatcaatacggaggctacccactccacattaccttctttccaagggcctatttcccttgcctccataactgttgtgggtattgatggcccagcttcaaaaccccttaaaattcccccactctggtgccaacttggacaacattcttttatgcactcttttttcagttatccccacctgcccagttcccttattaggccaagatattttaaccaaattatctgcttccctgactattcctggactacagccacatctcattgccgtccttcttcccaacccaaagcctcctttgcgtcttcctcttgtatcccccaaccttaacccacaaatatggaatacctctactccctccctggcaaccgatcacatgcccattactatcccattaaaatctaatcacccttaccctactcagcgccaatatctcatcctgcagcatgctttaaaaggattaaagcctgttatcactcacctgctacagcatgggcttctaaaacctataaattctgcttacaatacccccatcttacctgtcctaaaaccagacaagccttacaggttagttcaggatctgcgccttatcaaccaaattgttttgcctatccaccccgaggtgccaaacccatatactctcctatccttaatacctccctccacaacccattattctgttctagataaacctagctgaccccataaatcctaaatcctttccccactcccctttccattccttaaaaaacagccctaaaagctgctcctatgctggctctccgtaactcttcactcccttttcattacatacagctgaagtgcagggctgtgtggtcggaattcttatacaaggaccaggactgcgccctgtagcccttttatccaaacaacttgaccttactgttttagcctagccctcatgtctgtgtgtggtggctaccactgtgttaatgcttttagaggccctcaaaatcccaaactatgctcagctcactctctacagttctcataatttccaaaatctattttcttcctctcacctggctccttcagctatactcactcttagttgagtctcccacaattaccattgttcctggcctggacttcaatctggcctcccacattattcctgataccacacctgacccccatgactgtatctctctgatccacctgacattcaccccatttccccatatttccttctttcctgttcctcaccctgatcacacttggtttatcaatggcagttccaccaggcttaatcgccacacaccagcaaaggcaggctatgctatagtatcttccacatctatcattgaggctaccgctctgccccccactatctctcagcaagctgaactcattgcctgaacttgggccctcactcttgcaaagggactacaaatcaatattaatactgactctaaatatgccttccatatcctgcaccaccatatgggcagaaagaaatttctcactatgcaagggtcctccatcattaatgcctctttaaaaaaaaaacatttctcaaagctgctttacttccaaaggaagctggagtcattcactgcaaaggccatcaaaaggcaccagatcccatcgctcaggacaatgcttatgctcataaggtagctaaaaaagcagccatcaaaaggcatcagatcccatcactcaggacaatgcttatgctgataaggtagctaaaaaagcagctagcattccaacttctatccctcacggcagtttttctccttctcatctgaccactcccacctactccccactgaaacttccacatattaatcttttcccacgtaaggcaaatggttctttgaccaaggatctccttccagcctcacaggcccattctattctgtcatcatttcgtagtctcttccatgtaggttacaagccactagcccatctcttagaacctctcatttcctttccatcgtggaaatctatcctcaaggaaatcacttctcagtgttccatctgctattccactactccccaggaatttctcaggccccctcccttctctacacatcaagctcggggatttgccctgcccaggactggcaaattgactttactcacatgccccgagtcaggaaactaaaatacctcttggtctgggtagacactttcactggatgggtagaggccttttccacagggtctgagaaggccaccatggtcatttcttcccttctgtcagacataattcctcgttttggccttcccacctctatacagtctgataacggaccagcctttattagtcaaatcacccaagcagtttctcaggctcttggtattcagtggaaccttcataccccttatcatcctcaatcttcaggaaaggtaaaatggactaatggtcttttaaaaacacacctcacgaagctcagccaccaactttaaaaaaaggactctgtcaagaatagagcccaaaaactcaccaaccaaacaagtaattacactgaacccccttggacactctctaattggatgtcctgggtcctcccaattcttagtcctttaatacctatttttctccttcttttatttggaccttgtgtcttctgtttagtttctcaattcatacaaaaatgcatccaggccatcaccaatcattctatatgacaaatgcgccttctaacaaccttaccgcaaaatcttccttcagcttaatctctcccactctaggttcccacgctgcccctaattccactcgaaccagccctgagaaacatcactcatcatctctccataccaccccccaaaattttcaccaccccaaaactttaccaatattttgttttttgttatttttcttattaatataaggagacaggaatgtcaggcctctgagcccaagctaagccatcatatcccctgtgacctgcacgtatacatccagatggcctgaagtaactgaagaatcacaaaagaattgaaaatggcctgttcctgccttaactgatgatattaccttgtgaaattccttctcctggctcatcctggctgaaaagctcccccactgagcacattgtgacccccgcccctgcctgccgagaactacccactttgactgtaattttcctttacctacccacatcctataaaacggccccaccctatctcctttcactgactctcttttcggactcagcctgcctgcacccaggtgaaataaacagccttgttactcacacaaagcctgtttggtgggctcttcacacggacacgagtgaaa

SEQ ID NO: 275 - DNA, 469 bp, Homo sapiens
tcccggccccacaccaggaaggtcaggtgaccatcaagcacccgtcaggcagttgttaagctgtctccctaaaataacaattggtcgcagccggggccaaggaaaggcagtctgccaatagatagaaacacctgaaactggtgaccagcagcttcctgataagatctcaggagttgagccagtggactcacccgtgtgctctaagaggcagaatgggaagtttaactggtatataacctttctgtaggaatgctagactggtaagggaagaatgcccgaagtgagcatgcgtacaactccagtaaacacattgcgcatgaagcccctcccaaggtctagcaggccactgtgcatgtggaaagcccatcctaagggaagaatcaaggcagaagaggctcaagaccccggaagtatgccaatgtgcaaaaccccaagtcaatgatcagacagtgcacttgatctcttaagt

SEQ ID NO: 276 - DNA, 6574 bp, Homo sapiens
gtcaggcctctgagcccaagctaagccatcatatcccctgtgacctgcacgtatacatccagatggcctgaagcagctgaagatccacaaaagaagtgaaaatagccaggtgctgccttagctgatgacattccaccactgtgacctgttcctgccccaccctaactgatcaattgacctatgacaatacaccctccctgcccttgtgataatgtactttgtgatattcccctgcccttaagaaggtactttgtgatattcccccgcccttaagaaggtactgtgtgatattcccccgcccctaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtactttgtgatattcccccgcccttaagaaggtacttgtgatattcccccgcccttaagaaggtactttgtgagatccaccccctgcccacaacaaattgctcctaactccaccgcctatcccaaacctgtaagaactaatgataatcccaccaccctttgctgactctcttttcggactcagcccgcctgcacccaggtgattaaaaagctttattgctcacacaaagcctgtttggtggtctcttcacatggatgtgcgcgacatttggtgccaaaacccgagaatggttctaaatggccagaaaatgacacttttgatttctccatcctacaagatctagataattttgtcgaaaaatgggcaaatggtctgaggtgactgacatcccggcattctttcacacatcggtccctccctagtctctgctcccagtgcgacttgtcccacatctttcttctttctcttctgtctgttccttcagtcccaaccccaagcgtcactaagtcttttgaatcttccttttctacccacccatctgacctctccccttcttcccacactgctcctcctcaggtcgctccctgccaggctgaatcaggctccagcttttcttgagcttccgctcccctaccctacaacccctctatcacctcccctgccacacccagtctggcttacagtttcattccatgacgagccctcccctacctgcccaacaatttcctcttaaagaggtggctggagctaaaggcatagtcaaggttaatgctcctttttctctatcagacctttcccaaatcagttagtgtttaggctcttttccatcaaatataaaaacccagcccagttcatggcccgtttggcaacaacccttagatgctttaccgccctagacccagaggggccagaaagccatcttattctcaatatgcgttttattacccaatctgctcctgatactagaaaaagctccaaaaattagattccagccctcaaaccccacaataggacttaattaacctcgccttcaaggtgtacaataataaaaaagagtcagccaagtggcaacatatttctgagttgcgattacttgcctctgccgtgagagaaaccctagccgtatccccagcacacaagaccttcaaattgcctaaaccgcagaggacaggcgttccttcaggacctcctcccccaggatgttgctccacgtgacggaaatctgaccactgggccaaggaatgccagcagcctgggattcctcctaagctgcgtcccatctctgcgggaccccactggaaattggactgtccaactatcccagcagccactcccagagcccctggaactctggcccaaggctctctgactccttcccagatcttcttggttcagcagctgaagactgatgctgcccgatcgcctcggaagcctcctggaccatcacagatgctttgggtaactcttacagtggagggtaagtctgtccctttcttaatcaatacggaggctacccactccacattaccttcttttcaagggccttttcccttgcctccgtaactgttgtgggtattgacagccaggcttctaaacctcttaaaactccccaactctggtgccaacttggacaatactcttttaagcactccttttcagatattcccacctgcccagcttccttattaggtcgagacattttagccaaattatttgcttccctgactattcctgggctacagccacacctcaataacctcccttcacaacccatcattctgttctggttctcaaatatgcttcctttactattcttttccatccttcatcccagcctctcttcgctttcacttggactgatcctgacacccatcaggctcagcaaattacctgggctgtactgccgcaaggcttcacagacagcccccgttacttcagtcaagccctttctcatgatttactttcattctgtccatctgcttctcaccttattcaatattttcacgaccttctactttatagctgcccccccccaccaaaatcttctcaacaggacaccctcctgttcctctaacatctattctcaaagggatatcacatattcccctccaaagcacaaatttcttcctcatcggttacctatctcggcatgattcttcataaaaacacacgtgttttccctgctgatcatgtccagctaatctcccaaaccccaaccccttctacaaagccacagctcctttccttcctaggcatggttaagtactttcacctttggatacctgattttgccatcctgactaaaccattacataaactcacaaaaggaaacctacctggccccatagatcctagatcctttccccactcctctttccattccttaaaaacagccctagaagctgctcccacactagctctccctaactcatcccaacccttttcattacacacaaccaaagtacaggactgtgcagtcggaattcttacacaagagctgggaccgtgccctatagcctttctatccaaacaactcaacttcacaattctgggctggccctcatgtttgtgccatttaaatacttctagaggccatcaaaaatcacaggctatgctccacttaccctttacagctctcacaaccttcaagcattaatatcctcctcatacctttcacatttattgtctgccccccaactcctccagctctattcactctttgttgaaactccaatagtaactattacccatgggcctgatttcaacccagcttctcatttagcacccaacacaagtcctgaaccacatgactgtatttccctaacacacataggatcttctccctttcctcatatttctaatcttcccattccaaacccggaccacacttggtttattgatggcggttcttctaaacccaatcaattttcaccagctaaagctggatatgctgtcatgtcccacacctctattattgaagctgctgcacttcctccctccaccacttcccaacaagccaaactgattgctttaactcgtgtgctctctctagctaaaggaatgcacattaacatttatactgactccatatatgctttccacatcctccataaccatgctgccatctgggtcaaaagaggcttccttaccacacaaagctcttccactaataatgcctccctaatagaggcccttaaggttgttctcctgccagccaaggctggaatcattcattgtaaaggacaccagaaacctactgatcttattgcaaaaaaaaaataaccaatgcctccacacccgctaatattccagcccccactccggagggccagtatttttttttctcctctatcactcccacctactcttcttctgaaaacctgctctaccagtcttttccaactcagggcaagtggttcttagatcatggaaaactcatccttcctgcctcacaagctcagtccattctttcgtcttttcataacctcttccatgtaagttacaagccactagcccgcctcttagaacctctcatttcctttaagacatttgccctgcatttcactccatccttagctaccttccccttgttctttggactctcctcttagcccctcctcttgcttgcttatacccagccccatgaatagcagtgaacggttactcgtagacactttgtactttctcatacaccataaaaatcaaacctccccttctacccagttgctccatcaatccccattacaacctctaacggctgctgcccttactaaatccctaagagtctgggtgcaagacacctgttttggtgctccctcttgtcttttcactttacatttccagttttgccttacaaagttctcttcttggacatgaacagacacttctcaaacgaagacatttatgcagccaaaaaacacatgaagaaatgctcaccatcactggccatcagagaaatgcaaatcaaaaccacaatgagataccatctcacaccagttagaatggcaatcattaaaaagtcgggaaacaacaggtgctggagaggttgtggagaaataggaacacttttacactgttggtgggactgtaaactagttcaaccattgtggaagtcagtgtggcgattcctcagggatctagaactaggaataccatttgacccagccatcccattactgggtatatacccaaaggactataaatcatgctgctataaagtcacgtgcacacgtatgtttattgcactattcacaatagcaaagacttggaaccaatccaaacgaccaacaatgatagactggattaagaaaacgtggcacatatacaccatggaatactatgcagccataaaaaatgagaagttcgtgtcctttatagggacatggatgaaattggaaatcatcattctcagtaaactatcgcaaggacaaaaatccaaacaccgcatgttctcactcataggtgagatttgaacaatgagaacccatggacacaggaaggggaacgtcacactctggtgactgttgtggggtggggggaagggggagggatagcattaggagatatacctaaagctaaatgacgagttaatgggtgcagcacagcagcatggcacacgtatacatatgtaactaacctgcacattgtgcacatgtaccctaaaacttaaagtataataataataataataataataataaaaaagatgtcttcctcctctgtggctccttcacctacatgtgtctacctattaattagacaggcacatgtacactagttagccttacccccaaaatcaatttgcaaataggaccgaacagcttcctgttcccctcatgacactaacactttacttctattttgtttttttattattattattaatataagaaaacaggaacaggccttgacttactcactgctgaaaaaggaagactctgtgtatttttaaatgaagagtgttgtttttacctaaatcagtctggcctggtatatgacaacataaaaaaatgcaaggatagagcccaaaaactcatcaaacaagcaaataattaggctgaacccccttgggcactctctagttgaatgtcctgggtcctcccaattcttagtcctttgatacctgtttttctctttctcttacttggcccttgtgtcttccaattaatctctcaattcctacaaaactgcatccagactatcactaatcactctatatgacaaatgctgcttctaacaaccccacaatatcaccccttaccccaaaatctttcttcagtttaatcactcccactctaggttcccacactgcccctaatcctgctcaaagcagccctgagaaacatcgcccattatctctccataccacccgcaaaaatttttgccaccccaacacttcaccaccattttgttttgtttttcttattaacagaagaagacaggaatgtcaggcctctgagctcaagctaagccatcatatcccctgtgacctgcatgtatacatccagatggcctgaagcaactgaagatccacaaaagaagtgcaaatagccaggtcctgccttagctgacgacattccaccattgtgacctgttcctgccgcaccctaactgatcaattgaccttatgacaatacaccctccccgcccttgcgataatgtactttgagatattcccctacccttgagaaggtactttgtgatatttccccacccttgagaaggtactttgtgatattctcccacccttgagaagttactttgtgatattcccccacccttgagaaggtactttgtgatattcccccacccttgaaaaggtactttgtaatactctccctgcccttgagaatgtactttgtgagatctaccccctgctcctaactccaccgcctatcccaaacctataagaactaacgataatcccaccacactttgctcactctcttttcagactcagcccacctgcacccaggtgattaaaaagctttattgctcacacaaagcctgtttggtggtctcttcacatggacgtgcgtga

SEQ ID NO: 277 - DNA, 3863 bp, Homo sapiens
gtcaggcctctgagctcaagctaagccatcatatcccctgtgacctgcacatatatatccagatggcctgaagcaagtgaagaatcacaaaagaagtggaaatggctggttcctgacttaactgatgacattaccttgtgaaattccttctcctggctcagctactcctccactgagcaccttgtgacccccgcccctgcccgccagagaacaacccccttttgactgtaattttcctttacctacccaaatcttataaaacggccccaccctatctccctttgctgactctcttttcggactcagcctgcctgcacccaggtgaaataaacagccttgttgctcacacaaagcctgttggtggtctcttcacacagacgcgtgtgacatttggtgccgaaacccaggacaggaggactccttcgggagaccggtcccctgtcctcaccctcactccatgaggagatccacctgtgaactggggtcgtcagaccaaacaacccaaggaacatctcaccaatttcaaatcaggtaagtggtcttttcactctcttctccagcctctctcgctacccttcaatctccctgtccttccaattccagttctttttcctctctagtagagacaaaggagacacattttatccgtggacccaaaactccggcgctggtcatggactcgggaagacagtcttcccttggtgtttaatccctgcggggacgcctgcctgattattcacccacatttcactggtgtctgatcaccacggggacacctccttggtcattcacccacattcccttggtggcaagtcaattgcggggttgcctgctttggctgctcacccacactgcagcccagggctgctcaccacccccttctccgtgtctctaccctctcttttctctgggcttgcctccttcactatgggcaaccttccaccctccattcccccttcttctcccttagcctgtgttctcagaaacttaaaacctcttcaactctcacctgacctaaaacctaagcatcttattttcttctgcaacaccgcttgggccccaatacaaactcgataatggttctaaattgccagaaaatagcacttttgatttctccattttacaagacctggatgaattttgtcaaaaaatgggcgaatgggtctgaggtgctcgacgtccaggcattcttttacacattggtccctccctagtctctgctcctaatgcgactcacccgatatccttcttctttctctcctgtctgttccttaagtctgcatcccaagctctgagtcctttgaatcctccttttctacagacccatctgacctctcccctcctccccaggctgttcctcgccaggccgagccaggtcccaattcttcctcagcctccactcccataccctataatccttctgtcccctcccctgctcacacctggtccagcttacagtttcattccgaaactagccctcccccacctgcccaataatttcctcttaaagagatggctggagctgtaggcatagtcaaggttaatgctcctttttctttatctgacctctcccaaatcagttagcgtttaggctctttttcatcaaatataaaaacccagcccagttcatggctcatttggcagcaaccctgagacactttacagccctaggccctgaaaggtcagaaggccgtcttattctcaatgtgcattttattacccaatcagctcccgacatttaaaaaaagctcaaaaaattagatcctggccctcaaaccccacaacaggacttaattcacctcgccttcaaggtgtacaataatagagaagagttacaattacttgactctgttgtgagacaaaacccagccacatctccagcacacaaaaacttcaaaatgcctaagccacagtggtcaagcattcctacaggacctcctccatcaggatcttgcttcaagtgccagaaatctggccactgggccaaggaatgcccacagcccaggattcctcccaagccatgtgccatctgtgtgggaccccactggaaatcagactggccaactcacccggcagccactcccagagcccctggaaccctggcccaaggccctctgactgactccttcccagatctccttggcttagtggctaaagactgatgctgcccaatcacctcagaagcctcgtggaccatcacagatactttggataactcttatagtggagggtaagtccgtccccttcttaattaaaatatggaggctacccactccacattactttcttttcaagggcatgtttcctttgcctccataactgttgtgggtattgatggccaggcttctaaacctcttaaaactccccaactctgatgccaacttggacaacattcttttatgcactcctttttagttatccccacctgcccagctcccttattaggttgagacactttaactaaattatctgcttccctgactattcctaggctatagccacacctcattgccgcccttttccctagttcaaagcctcctttgcatcctcctctcatatcccccccaccttaacccacaagtatgggacccctctactccctccgtggcaaccaatcacacgcccattactatcccattaaaacctaatcacccttaccctgctcaacaccaatatcccatcccacagcacactttacaaggattaaaactcattatcactcacctgttacagcatggccttttaaagcctataaactctccttaccatttcctattttacctgtccaaaaaccagacaagtcttacaagttagttcaggatccacactttatcaaccaaattgttttatctatccaccccgtggtgccaaacccacatactctcctatcctcaatacctccctccacaatccctccacaacccattattctgttctggatctcaaacatgctttctttactattcctttgcacccttcatcccagcctctcttcgctttcacttagactgaccctgacacccatcaggctcagcaaattacctgggctgtactgccgcaaggcttcatggacagcccccattacttcaatcaagcccaaatttcttcctcatcccttacctatctcggtataattcttcatgaaaacacacgtgctctccctgctgatagtgtccggctaatctcccaagccccaaccccttctacgaaacagctcctttccttcctaggcatggttaggtacttccacatttggatacctagttttaccatcctgactaaaccattatatgaactcacaaaagcaaacctagctgaccccatagatcctaaatcctttcaccactcctctttcccttccttaaaaacagccctaaaagctactctcacactagctctccctaactcatcccaacccttttcattacacacagccaaaatacagagctgtgtggtcaaaattcctacacaacagccaggaccatgccctgtactctttctgtccaaacaacttgcccttactgttttaggctggcccctacattattcctgataccacacctgacccccatgactgtatctctctgatccacctgacattcactccatttccccatatttccttcttttctgttcctcaccctgatcacacttggtttattgatggcaattccaccaggcctaatcgccactcaccagcaaaggcaggctatgctatagtatcttccacatctattattgaggctattgctcttccccgctccactatctctcagcaagccgaactcattgccttaactcaggccctcactcttgcaaaaggagtacgtgtcaatatttatactgactgtaaatatgccttc

SEQ ID NO: 278 - DNA, 354 bp, Homo sapiens
ccacaaaaaaagtgaaaatagccagttcctgccttaactgatgacattccaccattgtgatttgttcctgctccaccctaactgatcaattgaccttgtgacattccttctcctggacaatgagtctcagaatctccccactgagcactttgtgacccttgcccctgcccacaagaaaaagaaaccctttaactgtaattttccattacctacccaaatcctataaaactgccccaccccatctccctttgctgacctctttttcagactcagtccgcctgcacccaggttattaaaaagctttattgctcacgcaaagcctgtttggtggtctcttcacatagacacatgtga

SEQ ID NO: 279 - DNA, 4057 bp, Homo sapiens
cttctcccttagcctgtgttctcaagaacttaaaacctctttaactcacacctgacctgaaacataaatgccttcttttcttgtgcaatattgctggcccccaaaacaaaatcaacaatggttccaaatagccagaaaatggcacttttgatttctccatcctacaagacctagataatttttgtcaaaaaatgggcaaatggtctgaggtgactgacatccagacatttttcacactttgttcccaccctagtgtctgttcccaatgcaactcttcccaaatcctccttctttccaaactgcctgtcccttcagtcccaaacccaagtgtcactgagtcttttgaatcttcctttttcacagtcccatctgacctctctcctcctccccagactgcttctcctcaggtcactccctgccaggctgaatcaggctccaactcttcttcagcctctgctcccccaccctacaacacttctgtcacctcccttccccacacctgttctggcttacagttttgttctgcaactagctctagcccacctgctcaaaaatttcctcttacagaggtggctggagctgaaggcatagtcaaggttaatgctcctttttctttagctgacctctcccaaataagtcagcatttaggctctttctcatcagacccccctaaatatatacaggaattccaatatctaactatgtcctacaatttaacattgagtgacttaaatgtcatcctaacttaaaccctctccacagatgaatgggaaagattattttttctctagcccaatctcatgctgacaaccaccggcttcataagccagacctccaggaaggcattagagtagttccccgagaggatccccaatggaactatcaggcagattcctcaggtatagctaggtgagatcacatgatttcctgcctagttgaagggcttaaaaaggcagcatacaaacctgttaattatgacaaacttaaagaaactactcaaggaaaaaattaaaacacagcccagcccatggctcatttggcagcaaccctgagaagctttacagccttggacccagaagggccagaaggccatcttactctcaataagcgttttattactcaatcagctaaaaccttcaaaaattggaatctggccctaaaaccccacaacaagaattaattaaccttgcttttaaaaagtgtacaataataaagaagaggcagccaagtggcaacatatttctttgtcgcaattacttgcctctgctttgggagaaaccccatccaaatctctggcacaaaagaacttcagaatgcctaaacagcagcagtcagccattcctccagggtctcctcccccaggatcttgcttcaagtgctgaaaatctggccactgcaccaagatatgcctgaagcttggtattcctcctaacctgtgtcccatctgtgtgggaccccactggcaattgaactgtctgaatcacccagcaaccactcccagagcccttggaactctggcgtcaggatctctgactaactccttcccagatcttctcagctttgcggttgaagactgacacgcccaatcacctcggaagcctggacaattacagacactttaggtaactcttacagtggaaggtaagtccatccccttcttcatcaatatggaggctacccactccacattaccttcgtttcaagggcctgtttcccttgcctccataactgttttggttattgatggtcaggcttctaagcctcttaaaactccaactctggtgccaacatggacaacattcttttatgtactcctttttagttatccccaccttcccagctcccttattaagtagagacatttaaactaaattatctgcttccctgactattcctgggctacagccacacttcattgccacccttttccccagttcaaagcctctttacatcctccccttgtgtctccctaccttaatccataagtatgggacacctctactccctgcttagtaactgatcatgtactttttatcatccattaaaaactaattgcccttatcccagtccacatcaggctttaaaagggttaaagcctgttatcatccacctgttacaacatgtccttttaaagcctacaaactttccttaaaactctcctatcctacccatccaaaaaccagacaagtcttacagtctggtcaaggatctttgccttatcaactaaattgtcttgcctatctaccccgtggtaccaaacttatgcattcttctatcttcaatacttccctccaaaagccattattctcctctacatctcaaacatgcttcctttactattactttgcacccttcatccaaggctctcttcactttcacttggacaatgaatcaccttgatgaagtcctattctttacttttatactcattcttattctcattgcaattcttatgccaccctctacctctccacagctatctccactacactatcaatctcattcacttagctgtttctaatccctccttagcaaacaattgttggctttgcatttccctttcttcctgcacttacacagctgtccctgccttacatacagactgggtaacatctcctttctccctatatctctgaacttttttttttttaacaacattcacctttaccctccagaagaacttctttactttctagacagatccagcaagacctccccagacatttcacatcagcaagctgacacccttctccgcacttacttaaaaaacctttctccttatattaactctaattcccctataattggacccctcacaacacacactactattcctgtggctgttcccttatgcatctcttggcaaagacccactggaattcccctgggtagcaccttctctatgctccttcactcttcatatgtaaagcctaattacacccattcctgaaaaaaatagggctttccagctccatattacaaataagccctctatcaatacagacaaacttaaaagcactagcagttattattgcttaaaaagacatttaccctgtatttaacaccatcgttcgctaccttccccttgcttttcactcttctcccaggccctcttcttctttgcttatatccagctctgtaaataacagtgaaaggttgcgcatagacactcaaagctttctcatacaccataaaaatcacacctcttcctgtatgcagttgccccatcaatccccattacaacctctaatggattctgccctcactagatccctaaagagtctgggtgcaagacacctcttttagtactccttcttatcttttcactttgcatttccagtttttccttgcacaagttctcttcttcttctgtgaatcctctatctacatgtgtctacctgctaattggacagatatgtgcacactagttttccttactccaaacaccaagcaaataattatgctgaacccccttgggcactctgtaattggatgtcctgggtcctcccaattcgtagtcctttaatacctgtttttctccttctctttttcagaccttgtgtcttccatttagtttctctattcatacaaaactgcatccaggccatcatcaatcattctacatgacaaatgctccttctaacacctccataatatcaccccttaccccaaaatctttcttcagtttaatctctcccactctaatttcccactctgccccaatcccgcttgaaatagccctgagaaacatcacccattatctctctgtaccacccccaaaaattttcattaccccaatacttcaccatcattttgttttatttttcttattaatataagaagacaggaatgtcaggcctctgagcccaagcctgcatgtatacatccagatggcctgagggcaactgaagaaccacaaaagaagagaaaatggtcagttcctgccttaactgatgacattaccttatgaaattccttctcctggacaatgggtctcagatgcttcctgctgagcaccttgtgaccccctgcccctgccttcaaaaaagcaaccccc

SEQ ID NO: 280 - DNA, 351 bp, Homo sapiens
accaaagaagtgaaaatagccagttccggccttaactgatgacattccaccattgtgatttgttcctgccccaccctaactgatcaattgaccttgtgacattccttctcctggacaatgagtctcagaagctccccactgagcaccctataacccccacccctgtccacaagagaaaacccctgtttgactgtaattttccactatctacccaaatcctataaaactgccccaccccatctccctttgctgactccttttttggactcagtccacctgcacccaggtgattaaaaagctttgttgctcacataaagcctgtttggtggtctcttcacatggccaagcatg

SEQ ID NO: 281 - DNA, 160 bp, Homo sapiens; identical to SEQ ID NO: 269

SEQ ID NO: 282 - DNA, 8384 bp, Homo sapiens
gtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccacgctaactgatcaatgtactttgtaatctcccccacccttaagaaggtactttgtagtctcccccacccttaagaaggttctttgtaattctccccacccttgagaatgtactttgtgagatccacccctgcccaccagagaacaaccccctttgactgtaattttccattaccttcccaaatcctataaaacggccccacccctatctcccttcactgactctgttttcggactcagcccgcctgcacccaggtgaaataaacagccatgttgctcacacaaagcctgtttggtggtctcttcacatggacgcgcgtgaaatttggtgccgtgactcagatcgggggacctcccttgggagatcaatcccccgtcctcctgctctttgctccgtgagaaagatcaacctacaacctcaggtcttcagaccgaccagcccaagaaacatctcaccaatttcaaatccggtaagcggcctctttttactctcttctccaacttccctcactatccctcaacctccttctcctttcaatcttggtgctacacttgaatctctcccttctcttaatttcaattcctttcattttctggtagagacgaaagagacacgttttatccgtggacccaaaactctggcgctggtcacggactgagaaggcagccttcccttggtgtttaatcattgcagggacgcctctctgattatacgcccacgtttcaagggtgtcagaccacgcagggatgcctgccttggtccttcacccttagcggcaagtcccacttttctggggaaggggcaagtaccccaaccccttttctccttgtctctaccccttctctgcttttctggggaaggggcaagtaccccaaccccttctctccttgtctctaccccttctctgctttcctggggcaggggcaagtacccctcaaccccttctccttcaccctcagtggcaagtcccactttcctggggcaggggcaagtacccctcaaccccttctccttcacccttagtggcaagtcccactttcctagggggcaagaaccccccagttgcttatttccacaccccaacctcttatctctgagccccaatcccttatttctgcaccctgacctcttatttccgtgccccaaacccttctctgcttttctggagggcaagaaccccccaccccttctccgtgtctctactcttttctctgggcttgcctgcttcactatgggtaagcttccaccttccattcctccttcttctcccttagcctgtgttctcaaaaacttaaaacctcttcaactcacacctggacctaaaactaaatgccttattttcttctacaattttgcttgaccccaatacaaactcgacaggagttccaaatagccggaaaatggcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcctaaatcttccttctttccctcccgcctgtcccctcagtcccaaccccaagcgtcactgagtctttctaatcctccttttctacagacccatctgacctctcccctcctcgccagcccaagctaggtcccaatacttcctcagcctccactcctccaccctataatccttctatcacctcccctcctcacacctggtctggcttacagtttggttctgtgactagccctcccccacctgcccagcaatttattcttaaaaaggtggctggagctaaaggcatagtcaaggttaatgctccttttttttttatcccaaatcagacagcgtttaggctttttcatcaaatataaaaacccagcccagttcatggctcgttcggcagcaaccctgagacgctttacagccctggaccctaaaaggtcaaaaggccgtcctattctcaatatacattttattacccaatctgctcccgacattaaataaaactccaaaaattaaattccggccctcaaaccccacaacaggatttaattaacctcgccttcaaggtgtataataatagaaaaaagttgcaattccttgcctccactgtccccagccacatctccagcacacaagaacttccaaacgcctgaactgcagcggccaggcgttcctccagaacctcctcccccaggagctctctacaagtgccagaaatctgaccaccaggccaaggaatgcctgcagcccaggattcctcctaagctgtgtcccatctgtgcgggaccccactggaaattggactgttcaactcacctggcagccactcccagagcctgtggaactctggcccaaggctctctgacagactccttctcggcttagcggctgaagactgatgctgctcgatcgcctcggaggcccggtagaccatcacagacgccgagctttgggtaactctcacagtggaaggtaagtccgtccccttcttaatcaatatggaggctacccactccacattaccttcttttcaagggcctgcttcccttgcctccataactgttgtggatattgacggccaagcttctaaacctcttaaaactccccaactctggtgccaacttagacaatactcttttaagcactcctttttagttatccccacctgcccagttcccttattaggctgagacactttaactaaattatctgcttccctgactattcctggactacagctacatctcattgccgcccttcttcctaatccaaagcctcctttgcgtcctcctcttatatccctccaccttaacccacaagtataagatacctctactccctccttggtgaccgatcatgcaccccttaccatctcattaaaacctaatcacccttaccctgctcaatgtcaagatcccatcccacagcacactttaaaaggattaaagcctgttatcactcgcctgctacagcatggccttttaaagcctataaactctccttaccattcccccattttacctgtcctaaaaccagacaaggcttacaggttagttcaggatctgtgccttatcaaccaaattgttttgcctatccaccccatggtgccaaacccatatactctcctatcctcaatacctccctctactacccattattctgttctgcatctcaaacatgctttctttactattcctttgcacccttcatcccagcctctctttgccttcatttagactgaccctgacacccattaggctcagcaaattacctgggctgtactgccgcaaggcttcacagacagcccccattacttcagtcaagcccatatttcatccccatctgttacctatctcggcataattctcataaaaacacacgtgctctccctgctgatcgtgtccaattaatctcccaaacctcaatcccttacaaaagaacaactcctttccttcctaggcatggttagtgtggtcagaattcttacacaagagccaggaccacaccgtgtagtctttctgtccaaacaacttgaccttactgttttagcctagccctcatgtctgcgtgcagcggctgccgctgctttaatactgttagaggccctaaaaatcacaacctatgctcaactcactctctacatttctcataacttccaaaatctattttcttcctcatacctgatgcatatactttctgttccccagctccttcagctgtactaactctttaagtcccacaattaccattgttcctggcccggacttcaatctggcctcccacattattccggataccacacctgaccctcatgactgcatctctctgatccacctgacgttcaccccatttccccacatttccttcttccctgtttctcaccctgatcacacttggtttattgatggtagttccaccaggcctaatcgccattcaccagcaaaggcaggctatgctatagtatcttccacatctatcattgaggctacctctctgcctccctccactacctctcagcaagccgaactagttgccttaactcaagccctcactcttgcaaaaggactacgtgtcaatatctatactgattctaaatatgcctttcatattctgcaccaccatgcagtcatatgggctgaaagaggtttcctcactacacaagggtcctccatcattaatgcctctttaataaaaactctgctcaaggctgctttacttccaaaagaagctggggtcattcactgcaaggggcatcaaaaggcgtcagatcccattgctctaggcaacgcttatgctgataaagtagctagacaagcagctagctctccaacttctgtccctcacggccagtttttctccactttagtcactcccacctactcccccactgaaacttccacctatcaatctcttcccacacaaggcaaatggttcttagaccaaggaaaatatctccttccagccttacaggcccattctattctgttgtcatttcataacctcttccatgtaggttacaagccactagcccatctcttagaacctctcatttcctttccatcatggaaatctatcctcaaggagatcacttctcagtgttccatctgctattctactactcctcagggagtgttcaggcctcctcccttccctgcacatcaagctcgaggatttgcccctgcccaagactggcaaattgactttactcacatgcctcgagtcagaaaactaaaatatctcttagtctgggtagacactttcactggatgggtagaggccttccccacagggtctgagaaggccaccttggtcatttcttcccttctgtcagatataattccttggtttggccttcccacctctatacagtctgataacggaccagcctttactagccaaatcacccaagcagtttctcaggctcttggtattcagtggaaacttcatatcccttaccatcctcaatcttcaggaaaggtggaacggactaatggtcttttaaaggcacacctcaccaagctcagcctccaacttaaaaaggattggacagtacttttacctcttgctcttctcagaatcagagcctgtcctcgagatgctacagggtacagtccatttgaacttttatatggatgcattttcttgcttggccccaacctcatcccagacaccagccctctaggtgactatcttccagtcctccagcaggctagacaggaaattcgccaggctgctaatcttctcttgcctactccagatccccagccatatgaagacaccctagctggatgatcagttcttgttaagaatctgacccctcaaactctacaacctcgatggacaggaccctacttagtcatctatagtaccccgactgccgtccgcctgcaggatcctccccactgggttcaccattccagaataaagctgtgtccatcggacagccagcctaatccctcctcttcctcctggaagtcgcaaatactctcccctacttcccttaaactcactcgtatttctgaagaacagtaataacccttatgagcctaatacatcacttcattctattaggtcttttcatccttaccctactttttgcaacagggctttacgaagccacccccaccacttaggccgagccccaaaaaactagtcatccctactgtcttctgtccggtcatactcctattctccattctcaactacttataaatgccctactcctgtttacaccgccggtttacactgtttcttcaagccatcacagctgatatctcttggtgctatccccaaactgccactcttaactccctcttagagtgggtagatgatctttgctggcaaggcaccctccaatacttccaccctgatgaagttctattctttacttttatactcactcttattctcattcccattcttatgccaccctctacctctccccagctatctccaccacactatcaaccttacccattctctcctagccgcttctaatccctccttagcgaacaactgctggctttgcatttctctttcttccagtgcctacacagctgtccccgccttacagacagactgggcaacatctcccatctccctacacctccgaacttcctttaacagccctcacctttaccctcctgaagaactcacttactttctagacaggtccagcaagacttccccagacatttcacatcagcaagctgctgccctcttcgcacttatttaaaaaacctttctccttatattaactctactcaccccatatttggacctctcacaacacaaactactattcctgtggccactcctttatgtgtctctcagcaaagacccactggaattcccctaggtaatctttcaccttctggatgttcctttactcttcatctctgaagtccaactacacacatcactgaaataattggagccttccagctccatattacagacaagccctctatcaatactgacaaacttaaaaacattaacagtaattattgcttaggaagacacttgccctgtatttcgctccatccttggctaccttccccttgctcatcagactctcctcccaggccctcttcttgtttacttatactcagccccgaaaataacagtgaaaggttgcttgtagatactcaacgttttctcatacaccatgaaaatcgaacctcaccctctacgcagttaccccatcattccccattacaatctctgacagctgctgccttagctggatccctaggagtctgggtaaaagacacccctttcagcactccttctcatctttttactttacatctccagttttgccttgcacaaggtctgttcttcctctgtggatcctctacctacatgtgtctacctgctaattggacaggcacatgcacactagtcttccttacccccaaaattcaatttgcaaatgggaccgaagagctccctgttcccctcatgacaccgacatgacaaaaaagagttattccactaattcccttgctggtcggtttaggactttctgcctccactattgctctcggtactggaatagcaggcatttcaacctctgtcacgaccttctgtagcctctctaatgacttctctgctagcatcacagacatatcacaaactttatcagtccgccaggcccaagttgactctttagctgcagttgtcctccaaaaccgccgaggccttgacttacttactgctgaaaaaggaggactctgcatattcttaaatgaagagtgttgtttttacctaaatcaatctggcctggtgtatgacaacataaaaaactcaaggatagagcccaaaaacttgacaaccaagcaagtaattacactgaacccccttgggcactctaattggatgtcctgggtcctcccaattcttagtcctttaatacccatttttctcctccttttattcggaccttgtatcttccgtttagcttctcaattcatccaaaactgtatccaggccatcaccaatcattctatacgacaaatgtttcttctaacatccccacaatatcaccccttaccacaagacctcccttcagcttaatctctcccactctagattcccacgctgcccctaatcctgcttgaagcagccctgagaaacatcgcccattctctctccataccaccccccaaaaattttcgccactccaacacttcaacacttattttgttttatttgtcttattaatataagaaggcaggaatgtcaggcctctgagcccaggccaggccatcacatcccctgtgacttccacgtatatatccagatggcctgaagtaactgaagatccacaaaagaagtaaaaacagccttaactgatgacattccaccattgtgatttgttcctgccccaccctaactggtcaatgtactttgtaatctcccccacccttaagaaggtactttgtagtctcccccacccttaagaaggttctttgtaattctccccacccttgagaatgtactttgtgagatccacccctgcccaccagagaacaaccccctttgactgtaattttccattaccttcccaaatcctataaaacggccccaccccatctcccttcgctgactctcttttcggactcagcccgcctgcacccaggtgaaataaacagccatgttgctcacacaaagcctgtttggtggtcccttcacacggacacgcttgaaa

SEQ ID NO: 283 - DNA, 790 bp, Homo sapiens
gagagacaggactagctggatttcctaggccgactaagaatccctaagcctagctgggaaggtgaccgcttccacctttaaacacggggcttgcaatttatctcacatctgaccaatcagatagtaaagagagctcactaaaatgctaattaggcaaaagcaggaggtaaagaaatagccaatcatctatttcctgagagcacagtgggagggacaaggatcagcatataaacccaggcatttgagccagcaagggcaaccccctttgggttgcctccctttgtatgggagctctgttttcactctattaaatcttgcaactgcactcttctggtctgtgtttgttatggctcaagctgggctttcacttgccatctgtccaccactgctgctggctgccgtcgcagacccgccactgacttccatccctccagatccaacagggtgtccgctgtgctcctgatccagtgaggcgcccattgctgctcccgatcgggctaaaggcttgccattgttcctgcactgctaagtgcctgggtttgtcctaatcaagctgaacactagtcactgggttccatggttctcttccgtgacccacgccttctaatagagctgtaacactcaccacatggtccaaaattccattccttggaatccgtgaggccaagaaccccaggtcagagaacacgaggcttgccaccatcttggaagtggcctgctgccatcttggaagcagccaccaccatattgggagctctgggagcaaggacccctccaccccagtaacact

SEQ ID NO: 284 - DNA, 983 bp, Homo sapiens
gtgggggaaagaaagagagatcagactgttactgtgtctatgtagaaaaaggaagacataagaaactccattttgatctgtactaagaaaaattcttctgccttgagatgctgttaatctgtaaccctagccccaaccctgtgctcgcagaaacgtgtgctgtattgactcaaggtttaatggatttagggctgtgcaggatgtgctttggtaaaaatgtgtttgcaggcagtatgcttggtaaaagtcattgccattctccagtctcaagtaaccagggacaccatacactgcggaaggcagcagggacctctgcccaagaaaacctgggtattgtccaagatttcccccactgagacagcctgagagatggcctcgtgggaagggaaagacctgaccgtcccccagcccgacacccataaaaggtctgtgctgaggaggattagtgaaagaggaaggcctctctgcagttgagataagaggagggcatctgtctgctgctcgtccctgggaatggaatatctcggtgtaaaacccgatcgtacattctatttactgagataggagaaaactgccttatggctggaggtgagacacactggcagcaatactgctctttactgcactgagatatttgtgtaaagtcaaacataaatctggcctacgtgcacatccaggcacagctcctttccttaaatttatctatgacaccgagtcctttgctcacgttttcctgctgaccctctccccaccattaccctatagtcctgccacatccccctcaccgagatagtagggatagtgatcaataaatactgagggaactcagagaccagtgccggtgcaggtcctcacttgctgagcaccggtcccctgggcccacttttcttcctctatactttgtctctgtgtcttatttcttttctcagtctctcgtctccaccttgtgagaaatactcagaggtgtggaggggcaggccccc

SEQ ID NO: 285 - DNA, 6208 bp, Homo sapiens
gtcaggcctctaagccctagctaagccatcatatcccctgtgacctgcatgtacacatccagatggccggttcctgccttaactgatgacattctcccacaaaagaagtgaaaatggcctgttcctgccttaactgatgacattgtcttgtgaaattccttctcctggctcaaaatctcccctactgagcaccttgtgacccctactctgcctgccagagaacaaccccccttggactgtaattttcctttatctacccaaatcctataaaacggccccacccttatctcccttcactgactctcttttcggactcagcctacctgcaccctggtgaaataaacagctttattgttcacacaaagcctgtttggtggtctcttcacacggacgtgagtgaaatttggtgccgtgactcggatcgggggacctcccttgggagatcaatcccctgtcctcctgctctttgctctgtgagaaagatccacctatgacctcaggtcctcagaccaaccagcccaagaaacatctcaccaatttcaaatccggtaagcagcctctttttactctcttctccaacctccctcactatccctcaacctgtttctcctttcaatcttggcgccacacttcaatctctcccttcttttaatttcaattcctttcattttctggtagagacaaaggagacacgttttatccgtggacccaaaactccagcactggtcacggactaggaaggcagccttcccttggtgtttaatcattgcaaggacacctctctgattattcacccatgtttcagaggtgtcagaccacgcaaggacgcctgccttggtccttcacccatagcggcaagtcccgcttttctgggggaggggcaagtaccccaaccccttctctctgtgtctctaccccttctccacctttctggagggcaagaaatccccaaccccttcttcttcactcttagcagcaagtcccacttttctaggggaggggcaagtaccccaaccccttctcttcatgtctctaccccttctccacctttctgtaaggcaagaaacccccagccccttctccttcacccttagcagcaagtcccatttttctgggggaggggcatgtaccccaaccttgtatctctgcgccccgatcccttatttccacgctccgacctcttatatctctgtgccccaatcccttatttctgtgccccaacctcttatatctctgcaccctgctcccttatttccgtgccccaacctcgtatctctgtgccccgacccctttcctgcttttctggaaggtaagaacccccgaaccgcttccctccatgtctctactctcccttttctttaaacttgcctccttcactataggcaaccttccaccctccattcctccttcttctcccttagcctgtgttcttaagaacataaaacctcttcaactcttgcctgacctaaaacctaaatgccttactttcttctacaatgccgcttgaccccaatacaaacttgacaatggctctaaatggtcagaaaacggcactttcgatttctccatcctacaagacctaaataatttttgtcgaaaaataggcaaatggtctgaggtgcctgacgtccaggcattcttttacacatctgtccctccctagtctctctgcccagtgcaactagtcccaaatcttccttctttccctcctgcctgtctcctcagtcccaaccccaagtgtcgctgagtttttctaatcttccttttctacagacccatctgacctctcccctcctcactaggccgagctaggtcccaattcttcctcagcctctgctcctccaccgtataatccttttatcacctcccctcctcacacccagtccggcttacagtttcattccatgactagccctcccccacctgcctagctatttcctcttaaaaaggtggctgaagccaaacgcatagtcaaggttaatactcatttttctttatcagacctctcccaaatcagtgagcgtttaggctctttcatcaaatatgaaaaacccagcccagttcatggctcgtttggcggcaaccctgagacgctttacagccctagaccctaaaaagtcaaaaagccgtcttattctcaatatacattttattacccagtctgctcccgacattaaataaaactccaaaagttaaattctggccctcaaaccccacagcaggacttaattaacttcaccttcaaggtgtacaataatagagtggaggcagccaagtagcaacatatttctgagttgcaactctttgcctccactgtgagacaaaccccagccacatctccagcacacaagaactccaaacgcctgaaccgcagctgccaggggttcctccagaacctcctcccccaggagcttgctacaagtgcccacagcccaggattcctcctgagccatgtcccatctgtacaggaccccactgaaaattggactgttcaactcacctggcagccacttccagagcccctggaactctggcccaaggccgtctgactccttcccagatcttcttggcttagcagctgaagactggcactgccgatcgccttggaagcctacaggaccatcacagacactctaagtaactctcacagtggaaagtaagtccatccccttcttagtcaatacggaggctacccactccacattaccttcttttcaagggcctgtttcccttgcctccataactgttgtaaatattgacagccaggttctaaacctcttaaaactccccaactctggtgccaacttagacaatactcttttaagcactcctttttagttatccccacctgcccagttcccttattaggcggagacactttaactaaattatctgcttccctgactattcctaggctacatccacacctcattgccaccttttcccccagttcaaagcctccttcacatcctccccttgtatctccccaccgtaacccacaagtataagacacctctactccctccttggcgaccgatcatgcaccccttaccatcccattaaaacctaatcactcttaccccgctcaatgccaatatcctatcccacagcacgctttgaaaggattaaagcctattatcacttgcctgttagagcatggccttttaaagcctataaactcttcttaccattcccccattttacctgtcctaaaaccagacaagccttacaggttagttcagaatctgcgccttatcaaccaaattgttttgcctatccaccccgtggtgccaaacccatatactctcctatcctcaatacctccctctacaacccattattctgttctggatctcaaacatgctttctttactattcctttgcacccttcatcccagcctccctttgctttcacttagactgaccctgacacccattaggctcagcaaattacctgggctgtactgctgcaaggcttcacagacagcccccattacttcagtcaagcccaaatttcttcctcatctgttatctgtcttggcgtaattcttataaaaacacacgcgctctccctgccgatcgtgtctgactgatctctcaaaccccaacaccttctacaacctaggcatggttagatactttcaactttagatacctggttttgccatcctaacaaaatcattatataaactcacaaaaagaaacctagctgaccccacagatcctaaatcctttccccactcctttttctgttccttgaagacagctttagagactgcccccacctgagctctccctgactcatcccaaccctttgcattacacacagccaaagtgcagggctgtgcagttggaattcttacacaaggaccaggatcgcgtcctgtagcctttttgcccaaacaacttgaccttactgttttaggctggccatcatgtctctgtgcagtggctactgaccctaatactttcagaggcccttaaaatcacaaactatgctcaactcactctctacagctctcataatttccaaaatctattttcttcctcacacctgatgcatatactttctgctccccggctccttcatctctctgatccagctgatgttcacctcatttccccacatttccttcttccctgtttctcaccctgatcacacttagtttattgatggcagttccaccaggcctactcgccacacaccagcaaagacaggctatgctatagtacaagccactagcctgccttttagaacctctcatttcctttccatcgtagaaatctatcctcaaggaaataacttctcagcgttccatctgctagtctactactcctcaaggattattcaggccccctcccttccctacacatcaagctcaaggatttgcccccacccaggactgacaaattagctttactcaacatgccccgagtcaagaaactaaaatacctcttagtctaagtagacactttcactgaataagtaaaggcctttcctacaaggtctgagaaagccactgcggtcatttcttcccttctgtcagacataattcctcagtttggacttcccacctctatacagtccgatagcagacccacctttattagccaaatcagccaagcattttttcaggctcttagtattcagtgaaacctttatatcccttacagtcctcagtcttcagaaaaagtagaacagactaatagtcttaaaaacacacctcaccaagctcagccaccaacttaaaaaggactggacaatacttttaccactttcccttctcagaagtcagacctgtcctcagaatactacaaggtgcagcccatttgagctcctgtagagacactcctttttattaggccccagtcttattccagacaccagaccaacttagaccgtgcccccaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaagaatctttgctgaccggactatgctgaatctccttaggcactctctaatcagatgtcctaggtcctcccaattcttagaccttttatacccgtttttctccttctcttattccatttagtttttcaattcatacaaaaccatatccaggccgtcaccaataattctacacgacaaatgtttcttctaacaaccccacaatatcaccccttaccacaaaatcttccttcagcttaatttctcccattctaggttcccacgctgcccctaatcccacttgaagcagccctaagaaacatcacccattatctctccatgccatccccaaaaaattttcaccatcccaacactttaccactctttcgttttatttttcttattaatataagaagacagaggccgggcacggtggctcacgcctgtaatcccagcactctgggaggccgaggcgggcggatcacgaggtccggagatcgagaccatcctggctaacacggtgaaaccccgtttctactgaaaatacaaaaaattagctgggcgccgtggcgggcgcctatagtcccagctacttgggaggctgaggcaggagaatggcgtgaacccgggaggcggagcttgcagtgagccaagatagcgccactgcactccagcctgggcgaaagagcgagactccgtctcaaaaaaaaaaaaaaaaaaaagacaggaatgtcaggcctctaagccccagctaagccatcatatcccctgtgacctgcacgtacacatccagatggccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcccgccagagaacaacccccctttgactgtaattttcctttacctacccaaatcttataaaaaggccccactcctatctcccttcgctgactctcttttcggactcagctcgcctgcacccaggtgaaataaacagctttattgctcacacaaagcctgtttagtggtctctttacatggacgcaagtgaaa

The invention claimed is:

1. A method for detecting RNA transcripts, comprising:
obtaining a biological sample that is collected from a human patient suspected of having colon cancer; and
detecting, in the biological sample, the presence or absence of at least two RNA transcripts comprising a first RNA transcript expressed by a first nucleic acid sequence having at least 99% identity with SEQ ID NO: 2, and a second RNA transcript expressed by a second nucleic acid sequence having at least 99% identity with SEQ ID NO: 3.

2. The method as claimed in claim 1, further comprising detecting, in the biological sample, the presence or absence of a third RNA transcript expressed by a third nucleic acid sequence having at least 99% identity with SEQ ID NO: 1, 4, 5, 7, 8, 9, 10, 11, 12, 13, 15 17, 19, 22, 24, 25, 27, or 97.

3. The method as claimed in claim 2, wherein the third nucleic acid sequence has at least 99% identity with SEQ ID NO: 8.

4. The method as claimed in claim 1, wherein the at least two RNA transcripts are mRNA transcripts.

5. The method as claimed in claim 1, wherein the at least two RNA transcripts are detected by hybridization, amplification, or sequencing.

6. The method as claimed in claim 4, wherein the mRNA transcripts are detected by bringing the mRNA transcripts into contact with a probe and/or a primer, and detecting the presence or absence of hybridization to the mRNA transcripts.

7. The method as claimed in claim 4, wherein the mRNA transcripts are detected by detecting the presence or absence of cDNAs obtained from the mRNA transcripts.

8. A method for detecting RNA transcripts, comprising
obtaining a biological sample that is collected from a human patient that has been diagnosed with colon cancer; and
detecting, in the biological sample, the presence or absence of at least two RNA transcripts comprising a first RNA transcript expressed by a first nucleic acid sequence having at least 99% identity with SEQ ID NO: 2, and a second RNA transcript expressed by a second nucleic acid sequence having at least 99% identity with SEQ ID NO: 3.

9. The method as claimed in claim 8, further comprising detecting, in the biological sample, the presence or absence of a third RNA transcript expressed by a third nucleic acid sequence having at least 99% identity with SEQ ID NO: 1, 4, 5, 7, 8, 9, 10, 11, 12, 13, 17, 19, 22, 24, 25, 27, or 97.

10. The method as claimed in claim 9, wherein the third nucleic acid sequence has at least 99% identity with SEQ ID NO: 8.

11. The method according to claim 7, wherein the presence or absence of the cDNAs is detected by bringing the cDNAs into contact with a probe and/or a primer, and detecting the presence or absence of hybridization to the cDNAs.

12. The method as claimed in claim 1, wherein the first nucleic acid sequence is SEQ ID NO: 2, and the second nucleic acid sequence is SEQ ID NO: 3.

13. The method as claimed in claim 12, wherein
the at least two RNA transcripts are mRNA transcripts, and
the mRNA transcripts are detected by detecting the presence or absence of cDNAs obtained from the mRNA transcripts.

14. The method as claimed in claim 12, further comprising determining an expression level of the at least two RNA transcripts in the biological sample.

15. The method as claimed in claim 1, further comprising determining an expression level of the at least two RNA transcripts in the biological sample.

16. The method as claimed in claim 1, wherein no more than 285 specific binding partners are used to detect the at least two RNA transcripts.

* * * * *